United States Patent 11,396,665 (CRISPR-CAS SYSTEM FOR A FILAMENTOUS FUNGAL HOST CELL) - sequence listing, part 64

SEQ ID NO: 7 - DNA, 38042092 bp, Mortierella alpina ATCC 32222 (residues 35,928,651-38,042,092 of 38,042,092)
  misc_feature (16413)..(16413): n is a, c, g, or t
  misc_feature (94211)..(94211): n is a, c, g, or t
  misc_feature (107854)..(107854): n is a, c, g, or t
  misc_feature (117095)..(117095): n is a, c, g, or t
  misc_feature (155256)..(155256): n is a, c, g, or t
  misc_feature (239300)..(239300): n is a, c, g, or t
  misc_feature (245980)..(245980): n is a, c, g, or t
  misc_feature (313610)..(313610): n is a, c, g, or t
  misc_feature (359832)..(359832): n is a, c, g, or t
  misc_feature (751867)..(751867): n is a, c, g, or t
  misc_feature (768867)..(768867): n is a, c, g, or t
  misc_feature (846931)..(846931): n is a, c, g, or t
  misc_feature (863626)..(863626): n is a, c, g, or t
  misc_feature (1097056)..(1097056): n is a, c, g, or t
  misc_feature (1299567)..(1299567): n is a, c, g, or t
  misc_feature (1690471)..(1690471): n is a, c, g, or t
  misc_feature (1766977)..(1766977): n is a, c, g, or t
  misc_feature (1785290)..(1785290): n is a, c, g, or t
  misc_feature (1785296)..(1785296): n is a, c, g, or t
  misc_feature (1996018)..(1996018): n is a, c, g, or t
  misc_feature (2883286)..(2883286): n is a, c, g, or t
  misc_feature (3234950)..(3234950): n is a, c, g, or t
  misc_feature (3394760)..(3394760): n is a, c, g, or t
  misc_feature (3508823)..(3508823): n is a, c, g, or t
  misc_feature (3508830)..(3508830): n is a, c, g, or t
  misc_feature (4305290)..(4305290): n is a, c, g, or t
  misc_feature (6639811)..(6639811): n is a, c, g, or t
  misc_feature (9464202)..(9464202): n is a, c, g, or t
  misc_feature (10102176)..(10102176): n is a, c, g, or t
  misc_feature (10393520)..(10393520): n is a, c, g, or t
  misc_feature (10406905)..(10406905): n is a, c, g, or t
  misc_feature (10406909)..(10406909): n is a, c, g, or t
  misc_feature (13238047)..(13238047): n is a, c, g, or t
  misc_feature (13238054)..(13238054): n is a, c, g, or t
  misc_feature (13814657)..(13814657): n is a, c, g, or t
  misc_feature (16285313)..(16285313): n is a, c, g, or t
  misc_feature (16338477)..(16338477): n is a, c, g, or t
  misc_feature (19402061)..(19402061): n is a, c, g, or t
  misc_feature (37702003)..(37702003): n is a, c, g, or t
atcagacctacaggaagaatggatagaagggcacaaacaaaacaaaccacaaaaaagcatgcgtcctcaaacacacacacggagagagaggacagagatgttgtccagagaacgccctcgccctctagaagctcaatactcagcgctgttcgatcgggaatagaatggtacacagggctggagacacaaacgcaaacgatccaagtgtggcagtgcgtccttcgccaccgagcgaaatcacagtgtgtgcgagagcgagagagagagagagaggggtggaaaaagagagactgtttaagagacgtgacaaacagcagtgcaatagctaatcacacgcctcagaggagatcgcggtctcagggacgaggttgtcaaagtctcggatgtctctcactgccttggcccagttgctgaccctcgttttgatgttttgacttttgaataggaatgaggtgtcggtcgcttttcaccaggtcgtgcgggccatgactcctgtctttacgatcgccatctcagttgcgttcctgagcaaacgatacagcggcatgacctacctttcgctgctcccgcttcttctgggagtctacatggccactgtgggcgactactcttacacagccatgggcttctttctcacagtgcttggagctgtcctggccgccaccaagaccgtggtcacgaaccggattcaggttggacgacttcagctccaccctcttgatctcctgctccgcatgagtccgttggcgtttgtgcagactgttatcttttcgtggatgaagggcgagctggacgaggtggtgatcttctgcaagacggatatgagttataagctggtcctagcccttctcgtcaacggaatcattgctttcttcctcaactacgtctcattcactgctaacaagaagaccagtgcactcaccatgactgtagcaggtaaagagacgggaagtacttttttttttttttttttttttttgcagaaggagcttgcattttccaatcgtgcttacgctcatacattcatgcaaggacatggatggcctgaatgcaaagcttctgatttttttttgattttttctatattttcaatagccaatgtcaaacaagtgctctcgatcgttgttgcagtgacggtgttcaacacgacgatcggattcctcaatggcctaggcattgtcatgacccttcttggaggagcatgttacaggtacgcttcaccccccgccccttctcatcaaaaaaaaaagactttggacccctcatttcaggactaatcgggagtgcatgtgatttaaccctgaagctttcttactatctttcttcgtcagctatgtggactggcgcgaaaagaacatgagagcgagacctatgacgccagcgttccctttgccctcacctccaggagcagcagcaaaatcagaccccgagaaggaggagctgctcgatgtcaggatagtcagctagatctctctgttttcagcaatatgaagagcctcaagaccagaaccacacaacacctgaaacaaagaaagaaaaaaaaataaaaagatgatcgtatcactcgccagtaaggcacagcccccggaggagggggtttgtctcgttctctcacaccacactcttgctcaagcctcactctcttctgaagtgtggccaagccctcgtccgagttgacactcggcttgcaagacaacaacaacaacaaaaaaaaaaacgagattgaatcatgtatcaaattcgccgagctatgtgttatgtcttttcggttttgagtgaacttcattcgcttttttttttttagtacttcagtgtcaagttgacacttccatccaactgattgaactcgtactcgacgaccatatcaagttcatccgtcatctgcgcgaccatggaatcgtcgactcggaccatcagctccttcttggtcgtctttttatacacacccgagatcgtcgacgactggatctcgagcttctcggacaacttctgggtcaactcggccaacgtcagtcgctccagatacactgccctgtagacagcctcgccttcgatcttgatgtacaggcacagcgactgctgcttctttttccgcatctgaggcacataggtcggatccctgtccagcagttggtccgaagaaggtgcgccaccaccaccgccaccggcactctcgccctccccatgactgttataagacgaagcccgttcaagcgctccagacgcgtggtagccgttgatcgaacccgtcgtgtgagcgcccgagtcgtgaccgcgacgtcgtttcctggatcccggtacgagcgcgttggattctccgttatgactcgacaacgagtcggctgtccctggtgaatccaaaggcactgcagcagcggtcaagagcccgcccgcagtgtcgtgctgtccatcgtctccgcctccggcgtccgtgccagcagtgtctgaatcgagcgatccctgtgccaaggtctcggacaggtccaacgtctcgtcctcggccgagtcctcctgatgatccagacattcccagaagacagacacgctctggacgggggcgagcacctgggacagcggattcgtgtccgcgttcttgcctcgcatcttgtcccacatcttttcgagatgcttatgatcgtctttgttctttcgttcggctccctacgaaaccattaaacagaaagtaataagtaaatcacgcccaccgtgggaggttatcgttagcaaaaagcaaaaaatgaaggctgtaatatgtgtcgtgcgtgctaattaccttgtctcgaaagagcttaatctttgcatacgatcgctccacggcctgatcctggtcatcgccgttgaacatgccgccgtccagcatggtatccatgtgcacacggagagggatgcccttgacgcccttgatgcgagaaaagtcggtcgacagacagttgaatcggaccatgagcttcgcacctgcctttccgttccatttgaacgagatccggtcaaaggtcttggactggacctccatcatgccggttgacgatgccttttctacagtcaggggggtccatcgagtgataagaaaaaagaaagaaaaaaaaagaagaaaaagaggttggtctttgattgaaaccaccatgatgaacgaaaaaaaaccaaaggcgcgcgttcgcgtcttccctcggaaaagacacgtaccaatgtccagagccctcgctgtctttggattggtctgttgactcaaccaaaagctccagtatcgtgccgccatcttgcgatgcgcttcctcgtggaaggtgaccttaatgacgctattgatatcgccgtcaaactcctctgcgtcttgcaacgaaactgtgtagaattggcctaaaaacatgcattggaagggttgacaaggcggcgaatgataggtcagttcaccctcgtttctaatatagaattcatttcataggtcccattttcattcgagcaaggagacgagggggggggggggggcgctaaaaaaaaagcgaataacgatacccttgttgaggtaggtgacaggggtgtctccctgatgttgcatggccgctgtctgagcatccaacgtcactttgaatcgaagactaggacgggcggaaaaaaaaagtgcataagacacatagctcttgttagttttggactggtccttccatgggtttcacactcatgggaagatacatcaagaacagaacttatcaacgatcgagaaagagggagacgagagagggggagggaagtgtgtttcctactttgattcgctctcagacctcggagaagcagagccctcgatagatccggacattgctgacacagacgctgacgcctgttcgctgtgatgctcctgctggctatgcgcgaccgaggtggtagacgaggcgatggagagcgagctctcgagtccaccgttattcagctcgcgctgcatgagctgtaactgaggatgctgttgttgttgctgctgtggctgctgttgtggctgctgctgctgttgctgtggagaatgttgataatgctgcgggtactggttgttgatacctgaatgtcgttgctgatgctgttgctgcccctgttgctgctgcccctgttgcggctgctgttgcggagctgactgctgctggtgctgctgatgctgttgatgctgttgatgtggtggtggtggctgctgctgttgcggatgtggtggatatgactgggtctggtattgatattgtggttgcgagtgatactgctgctgctgacctttccctggagcggccatagtggatgtagagtggtcttgacggtagtaatcgtcagcacgttgttgagggtcctgttgatagtacggctgctgctgctgctgctgcacttgagcttgcgagtaaggtatactcggatgtcgcggcaaggtctgctgttgctgtcttgccgtctgggaataatccgcttgtggatagtagtaaggctgttgcgggtgctgctggtatgagtgtggcgggtagggtggttgcggttgatccggaatcggcggatgctgattgtgctgctggtgatggctttgcaggcggctgtcggcagcggcagaggtgttggcaatgctggcggtgcctaggccgtttgtattaatggtggtggaggaggattcctgctgctgcgggtaggaggtggatggagcagggtcgagcgacgaggacatggtcaagaccaatgtggcgccagaagcaagcgagaaggaatccgagctggagatgctgagcagagagagaggaaagagagaaagagaggaagatgggcttggctggatgagcaagcagcgagaacgagagcaagaagaagagaacgagggaaagcgagagaaagagaacgagagaaagagaggaaagagagaaggacagaaggacagaaggacagaaggacagaaggaaaggaaaaaaaaagaagggggtaaacgagggaaacaggcagggaagcgggtgtgcaaaatatcgaaaatagtgcgaaatgcgagtgggcgaggtgcgacgatgccgtatcgtgtgcagcctgtgcagcctgtgcaaagaccactgtggatgcgtggacgcgagtgcaacgccacgaggacaaggacgagcaacggccatgaacacctgtgcaaagaaccaaagaacgagacgaacgagaagaacgagcagaacgagcaaaaaaaaagaaatgatgccaccaggagtccagtcctgtcgcttatgtctgttgtctctggtctctagtctctttggtgcactcttcgtgttcgctggctgcctattgacagcagcagcaagcagaaggggtggttgtgtctctcggttctgctctgtctgtctgttgtgctgtcgaccagcagacgacagtcgccgtgcacctcctattccctccagccgaaaaccttcgtgcgaaagagactcacaatccaataccacaatccgtggcccgcaaacaggtattctggcctctgcctcgagcccctctcgccaaaccttctttttttttttttttctccctctcccgcgcccctcaaaaacacacacacaaagacacacacagacacacacacacacaaatcgcccatccttttcaccttcccgtttcgtccattcgtgtgtacagcacgtacgacgcacttcgtcattcagtcacactttgtgcatctactcggacgaagcgcgtaactcgcgttcagcgccttgcttcgttggcggcgggtgctcttaagagcaacgaccaaacacatagcagcacgagaagcgaggcatgcgcatgggtcgtgctctgcatagtttgcagtgcaaaaggatgcgtcggctcaaaagacagtatggaggcagtacatgtgtttagtatggaaatatggtattgtaaaatgtattgtgcttttcacaaaaatttccgctgtcggttagctattgtcgccttagttccccgtcaacccaaagttttcttcatttagccattttgacagaggtgctacagccctacaagccatagtcgcccactgcgtacatgaaaaacacatctgcaatacacactgtttctccgtttccacgacgctattcagtagcgcttctcctgctgttcaggccctcgctctctgtttctttctagccctcatcgttgctgagtgacatccctgcaaagatcgcctcagttcatgccatctcaacaatgagcaagcgcatcgaaaaacgcatccgctccctctcctgagaagccccgggttacttagtggaagtgtgagcgtttttctcgcagaaccgtcgtctcatgggtccattgctaattttcatttcacattaccctctaaatctagcttttttcctagcaaacaacggaagcgcatctccaggtctagttcgcagacactacttttcccggaaaaagatcagagtgagaaaacgagaaggctgtgtttgcctgccatgttggttgaggccatagagtctatagattcctctctgcgcgtaataaaaagtttgctgtctcagtcgctgactatcacaaatccatcagtgaaatcacagcgctgtcaatatgaagcaatgggccgttaggcggtgaccgactgctgctataaatgtcgtctttgaccgaggatgcgtctcttcttcacttttgccttctttcgaagtggatcagtctcaggtaagagcttaggcagtcaaagacgcaaagcaccttgccctgtttcccactctcctgcactccactgagtcccttgcttccgcgttctgatcacattttttcttcttacaacgctgcaagaaatgagctgtcctatgttccggtaagtgaactgcacaagtgccctcactagagcatgcccagaactcagagcaggcgtctaatcatagcttcttgtcgttgcaagtcgtgcaaggtctggagtttggtctttctccacaccaaaaaagaccaccccaatgtgccccctctcctttggttctttttttttcttttgcttgcttgaacattgtaagtcatccacgtcttttggtcctcatgtcgagctgcctacttttgaatgctttctaatattcctcgttgttcacttctctttgaaacatcagtttgcttccagggacaagtgcattgggtcgcgaatacagccagatattcacaactggaaaaagaccacgcttcccccgtccacgtggactccgggggagctcccctattgagggtgcatatagtaagttctgtaaaaaaaatgtttttttgaacagggatacacgaacacattctaacatttcaagttttcaactatccctggtaggcctatatgatatctcatatcagatcagtgcgcaattagaatatggacaatactgctcagtagacttcgaatgcgccgttttgctgtgtgagtcgactgtgtggggctagagacatgtttccggaggggatcgccgccgccagcactgcaagctttatacagtctgtcgtcatccgaaaggagactgcagtataataatgccggggggcagccaaaagaagtccctgagaaaccccaagggccgggacctcaggccagacgcactgagtcctcttgagtgtgcagatgagcgctttctttagcgtcatgggcgggcaagtaaaacgagccaaccatatgaagtcatcgccaaagttactgccgggaggtatataagaagcaaagagtcgcccacccgcttgcacctttctccagcaaaccacctccacgagaccgtcgctagttgctctcctcgcacccccttcacgcttgcattcttcctcttcagcccagatccagacttcctctctcaagctcctcgatcacctcgataacgcaccatcccccagcctacagatcaccaccgcccgcagacaaccatcccaccaacatgagacattcacccggcaagacactgaccagccgcaatatgaacgctaaggtgcgcaaggctgagtatgcagtccgcggtgaactcgccatccggtccgaacatataaaagttgtaagttgacagtcaaatcgcttcttgaaaaataagctctgccatttgagaatcgtcgttcataaatccacctttctttgcctctggcaccttaggaactcgccaacggggcctcctttcccttcaagcgcgttgttggctgcaatatcggcaatcctcaagcgttaaatcaaaagcccattacattcttccgacaggtaacacaaagcactcggcacaaattcaggcccaaagggcacatgcgagaggcttaagactaacaggagacactgtttttggccattgactggaacactaggttgcatcactggtggagtacccagatttgctcaaggacgagaacgaagagttgacttccaagctctaccctagtgatgccatcgcacgcgcaaagcttcttctcaaacatatcggttccgtgggtgcctactcccactctcagggtattccggctatccgcgagaacgtcgctaaattcattgcggaacgtgatggctatcccgcggatccctccaagatcttcctgacccagggcgcctcagcaggagtgcagctcacccttcaaatgatcgtggagcactcgcaggtcggcatcatgatccctatccctcagtacccactttacacagccacactggctgtactagatgctaatccggtgccgtattacttggatgaatccaaaggatggggtttgactgtaagttgtttctttgattgttgggcgctcagacgaaacaagaaaaaagccaaaaagagcacgcactaacctcgatgtcttgtgtgtatgtaaacagactcaagagctgcaaaggtcgtttgatgaagcagccgaaaaaggggtcgagacgcgggcgcttgtcatcatcaaccctggcaaccccacgggccagtgcctgacggaggagaacatgcgcgaaatcattggattctgccgcaagaacaagatcatcctcttagcggatgaggtgtaccagaccaacatctaccagcccgaacagcgaccgttccactcgttcaggaaggtgctcaagtcgatgggtcctgagtacgagggctttgagatgatttcgtaccattccatctccaagggtatgattggcgagtgcggccggcgaggcggatatttcgagtgcgagggtctttgcccctccatcctggagcagatctacaagatttcgtccatcagtctttgtcccaatgtccaaggtcagatcatggtcgatttgatggtaaatcctccaaagaagggcgatccctcttttgcactgtacaagcaggagtatgatgccatctatcattcactgatcaagcgcgccaagaaactggaggacatgttcaacaccctcgagggatatacttgcaactctgcggatggagccatgtatctcttcccacagatccgtcttccaaagaaagctattgaggctgctaaagaagcaggcaaggagcccgaccaattttattgtctggccatgctggaggccacgggtgtatgcatggtcgcagggtccggatttggtcaggtcgagggtaccgctcacttccgaagcacgttccttcctcagccggagctctttgatgagttctgcgcccagattgaggcctttcacaaagagtttatggacaagtacagagactagagagattcgatcctgcgtagaaagtataatttattcatatataccattcttgatcaacatcacactattcgtgtccctgtctaagcattgcatggcttcattcaagtatttagccaagctagtctatatctccttgactcttacagcaacatctgtcggtatagagatgccaatggcttgacctgtgaagctaagccaagtcattatataattctctataaacgacctggaattgctctcttcagcctgactaagggcgatcgtctccatcagcggtacggtctcgcaagggtgcatgtaaaagtatggcacgttcagaatagggtggtcctgctgtgatatgccgccattgagtcccgcatcgcggatgctgcttcgccattcttctggaaccagcgatccatatatctcttccagcgagatggccgttccatctaacgaaacaaagatggtggatcaagagtcagctcatcatccttagactccaattcatataccccaactgttcgaaggagctccctataagttataagataaagagtgcaaatcgtcctaaccacgtcgataagcgttgaagtagagaactgggacctgatagcttggcgaaaagatgatgtgatatgagaccgttagaatgtcaacgcctgtcgcgtcaggcaacgctaatgcgcccacttcctcgtcgtcctcgtctgggatggctccaaaatgctctgccaactcgtccaagatcagttggtcctcggggtctatctcatgagatcctgccttcggctctgtgtgctctgaagtgggctgcagtgacggattctgcttgtggcagtggatatgttgactcatagcaagatagccccgtaaaggttggccgctccttggctgcttgaataaaagtgtgcaaattcagcggattagattggatctactgaacagatgggtacatgtaacagcgcaaaatggccgatgcgtccagtgtggcgacgtacgcgatactcaatgtagctccatggagaatgatgctcggtctgtttcaagaacgctcggatggccacctcaaagtcgctatgtgagagccgtgctgggaattccggtcgtgctgtcgtgtctaggctcattgccgtgcgttgttcaagacaaggtacagcacagggacgttggcattgcaatagggctcacttgcgcaggacgaatgttcacaagggcgtctgtgtgcgtgagagtgtgcgagttgcgcacatcaacaaatccagtttacaaaattcatttggggcaagccactctagcctctcgtctcatgtccttctcacttaaccatgggaaacgccttaactgtgtttgattcggagtatggctcaatgcagagcgcagtgtagagcgaggatgccgacggtaaagcatgagaagcgcctttatttcgtttaatttggtgtatatacgcctcacagtgattgcaacagttcgatgggaagacatgaatatggacgggagcaaagataagagtattgttggggaggactgcacgtgggaagggcatggaggaagagcgcgaatgtatgagtgaggatgagtgattgggggggggagaggatgaaggcgagtgtgagtgatgggtgatgagagtgggcagtgagtgtagggatgagggagtgagggcatgaagatgagtctccgtttgtgctgggctgggtcagaagagtgcctgtgctgcttcagaagagtgcctgtgctgcttcagaagagtgcctgtgctgcttcagaagagtgcctgtgctgcttcaaagagaatcgtgctgcttcagaagagggaagtgctgcttcagaagaggatcgtgctgcttccaaaagaaatttgtgctggtctaaaacaagtttgtgctgcttgcgcaagaggtgcgtgcctgtcgcaacaccagctcgtgctggaacacaaaaagatcgtgcttctttcagaccagctcaaatccctgcttctcagggggactcaaccaggtctctgggtcgccaacagccacctcggtgcaacaatgatgcttccgaatacttcctctcatccagttacagctcgcgctctcccgtgcacaatcgcaaagtgagagatgaagaaaaaatgggttgacagacggatgtcttccatgacctatgccctgtcccgagaaaacgtgtagcgctggatggctgcaatgtcctggcccttgcgggcgctgccccacgaagtcgaacctcattccgcacccgctttattgcacgcggagcctggcagtgcgtttgattggacgtgcagagattttcgccctctcatcatacacaataggttcacccgttcacacagcgaccacaagagcagccataatatgagcgtccctgtcactgctcgatacctggctctcagcgattgaaagtgccttttgcacgagtctttcacactctgcctgccagatggaggggtaacaagagagcactttgcgccattgagaggctcctgaacgacctcttcagacgtgcgctctagaccagaccagacggcttctataagtgcgaaatgcgggatcgaaagtgtctacgagaaaaagttgtaattgcgagacagcatcgaggtcgcacaggggctctcgcgtttacaccccattggatgattgcgtaaagggaaagtgttcaagggaagcgaagggaacatacaggtgcataaacgtgctcgttctaaacaagagcagcagcgttctcacagtccagggatgatgtttgcccttagactgctccactccttgacccaaatgtaacttggctgtttgttttgcccaggagatataaagacgagtacctgcgctttccacttgtgctttttgctttggtctgttgcctgctactctggtccatcctccacacctccttcccaggtcctctatttcatccaagacaagccatgcgtcttctaacctttttaccgctactggctgtggctgctgcgcacgtcgagcaccttcagcgtagatcccagtctggtgctgttcagcctacgcccgttgacctgacaccactgcagtggggcgatgtcaatgtcatttctaccaccgacactcacggctggttagcagggtaattagatcagctcctctgtttgcagtagcatcaactgaagcaaactttccttgttcttcatttattacaagtcttgacagtgtcctcttcttcacttgacttgtagaaacacccgggagggttcttactctgcagattttggtgacttttcgtcttttatctcgcatatgcgtgaccaggcaaaccatcggcgccaggatcttttggttgtcgattcaggaggtagaggccttttgctgctatcattgtgaccgcatgcgccatcatgtctcgatctgacgttatgatatatagatctgcacgatggcaacggccttgcggatgccacccctataagcggccaagtctccaaccccatcttccagaaagtcaactacgatgcgctggccattggaaaccacgagctgtatctccctgagattgctgaagacacctacaaaaactttgcgcgcaagtggggaaggaagtatctcacatccaacactttcatcaaggatgcgcacactaacaagactgttcccatcggacgactttacaacaagttccgcatgaagtttggcagtacgtgcaaaagactcgagggtgcttgaaatcaaaatagcatgcagctttggcggctcactgatgttgtcaatcgaacccaacctgctattagcacgcgtgatgagctatggattcctctataactttaaaggtgccgcaaacaacaccgtcctggaatcctccaatgtcacggtgactctgccatggttccaaaaggcaagttgcttgcaatcttacccttcaatcccgtgccattcatgacgttcactctgttaagatgttaacggtcgcaatgcgtgattatgtaaactctgatagtctttgaaagaagatgttgacatgtacctaattgtcgggcacgtgcccgttcgctgggctgaggccaaggtcgtcatcagcgccatccgcgctgtgcacccctcaaagccgattttgctcttcggtggacatatgcatattcgcgatttcaccgcctatgatcctcgcgcttatggtctctcggctggccgcttcatggagaccatcggatggatgtccgtctctggcattcgcgatcgctcttgccgtgtcgaggctaactgcgttggcaagaacctgactgtcagccgtcgctacctgggtacgcacatttgtctggagagatatagccatccctcaagtgatacgactacctcctgactaactaccattcttacttctgtgatattagacaccaatctgcacacatacaaaactcactctctcgcccatcccaagcaaaagtttgacacttggagaggtcgcaagatctcgctagagataactaaacagcgcaaggctctcggtatctccaccaagctgggttgcgccccccaggattattacctgaaccggtacccatactccgacagccgctcgctcctgaagctggtcaccgacgagatcttgcctttctcagtcatcgacaaatcccgccccaacccagcctttgtcgtgatcaactctggaagccagcgttttgacgtctccaagggcgccttcactgtcgatgacacctatgtggtttcaccgttccataatgactttgttttcaccaccttgccttacaaggccgctaagaacattctcagtgctctgaacaaggctcctttccaaaagcgcgctgacgacgaaatgcacgccggcggcgatatgcctgccccgactgctaacgccacgttgacaccaggttatgtcaccaaggatgactatggttacggtggcgatgactggcctcacagccccatcccgtatgttgctggggccaactatgtctcgtcacctattcccacgggattgaatgacaatgacctggtcgatgttgcatggctgcccttcttcacgaacttgatgctccccatccttacgaacctggaccctactggcaaccatactggtctgccgtacgccgtcggtatcaccaccaacgagatgtggcccatttttgtaaaggccaagtggggcaattccacatgctgatttgatagatagagtatttacacatcaataacagcacagtcgtcgcttgcatcagatcctaggctaatcatacgtagtcgataagagtgcctgacacaagaatacgcttccagtgaagcccctggcatctttctatggcccatagcacccatatcatcaccctcatccgcgcctctcattggccgatcagacctcggttcttgccaatgctcgtcgactagtgcaaacatcgtcctctgacggcgctgccggtaccgttggcctcgccagagcaagggctttcgtccgagccgcttgaatcgctcgtccggccaaattcatcaatcggccagattcgccatttgcaaaggcccctccctttggagaacgggtcgattccgctacccacatagtgaaaatcgccaatcgctgaaaggactgcctcacgcccttctcggcactttgaaacctggaggtcactaaggtgggatgagctggagccaacattaatgtccagaaaactgcacgcgagaaatggcgcccttaagacgatgaaatcagggctgcgagccagttcgtcgccttctgggtgcaaaaatcggcattatgtggcagtacctcagttgcagcgcagcacatagcttcagacagctgttattctcggtcctcgcgctctatgacagctctagtgcagagacacacctcgtggccgcatcgcggaaccacaccccagctaacacatatcaggtgccttaagaaattgttgggaagcaaacacacattttacgttatgttagagtgccacttgttgttgatctcaacacagctaacgacctatatcacggacgaatcaatagagccatcgacacagtataagatggcctcatcgtcatattcacttgtgtaggatgctttcatttttgcttcttttattatagtgccccgactttaacatttacagatcatcaattcaaattgttcgctaaacatcttaaaaattccattccatatagatctctgaaggatcaatacgatataactgcagtacgatacgcgaattggtctgtcgtctaagctgctattgaatatacagtgcatcagttgtgtagttcctcgatgcggccacgaggtgtgtctctgcactagagctgtcatagagcgcgaggaccgagaataacagctgtctgaagctatgtgctgcgctgcaactgaggtactgccacataatgccgatttttgcacccagaaggcgacgaactggctcgcagccctgatttcatcgtcttaagggcgccatttctcgcgtgcagttttctggactgattaatggtggctccaactcattccaccttattaacctccaggtttcaaagtgccgagaagggcgtgaggcagtcctttcagcgattggcgattttcactatgtgggtagcggaatcgacccgttctccaaagggaggggcctttgcaaatggcgaatctggccgattgatgaatttggccggacgagcgattcaagcggctcggacgaaagcccttgctctggcgaggccaacgataccggcagcaccgccagaggacgatgtttgcactagtcgacgagcattggcaagaaccgaggtctgatcggccaatgagaggtgcggatgaggatggttgtatggtgggtatggggccattgaaagatgccagcaccctagtagaacagtgctccttttacatttcattttcttcaatatacgctattgtttcagtcttacgatgtctctatgtattccaaagctctgtgtacagctgcgcagctgcccccaatccttcaaaagttcgtgtcgaccggttggtagatttcactaccaggtgaagagcacgtcggagtagggcttggactttgcaaaggttgattgattctctcggccatctgacgctgagcctgcaaaacgtttgagtattgcttcaaaaccatattttggaccagcagagttgaaggttctctcaacatgcctgtcagattcgtgtgttgctggtgccaaagcagaatgagccgcaactcatggatccaccatgcattggacttgtcgacagttgctccgtgattgtacgaaaatggcattggatggtatccatacaggtgtgagtatgctgtttgctgatccctgtggtccgcaactgcgattctagcctcttcagcggccatgtctccgaggatgtaatggttgcggtcggtctctaccttgacgaggaattgcatatctgcctcgagaacactgtgggcttggtctgccctgagagtcaccaaatctcgtttttcaatcacatgccaccggccaggtgatcgggagtcgatccatccccgaaaaagtgaccgggcgctccactcaagcaaaggtgaggtcttggatcgactcatggcccaggctttgtgaagatactcgaacaaggcacggtggttgcggtcattaaagcgatatggcgcgtttcgaggcaatgttgaaaggttgtggacatctctacgctggcggataaaggcatgcaaggcccaagaaagaaggcgctgctgctcgtcgtcgagggagcgcagtcgaaggagaagctcgtacacgtgccctcctggatagggttcttcacctccgtaaagccactgagaggcgcaaggaatggctagaataaaatagcaaaaacaacattagaagatcatgagaaatcgcttccatcatgcccatcctattgtcaattctctcttacgcaccgctaatgaacttgacaagttcaattcggaaataaaggtaggcgttcaaggcattggcctctcggacagtgcagagcgacaagaaaccgaccaggtcctgcatgcttatgtgtagccagtgagcgacttgatctgtctgaaggtgctgtataacgggcgcggtctcccacggatggctgggtgacttgagcgggattgtccaaaattcaagctgaccttcggcagtgcctggctctttgatcataaaaaccgccgcatggtctggacccggggtgcgaggcatccagtagataatagacgagagcggcgtgttgtggtgctcctttgcaaaatcgaagcctttaagcatagacggaatggtgtgctggatccaagcttcgatagagatggatgaaagctgattgtacaccaaacatgaatatatacatggaggtcagcaggctgggcatggttttcatgtcacatttggttcgttttacgcacaaagtcattacctcgataccattttcaggcgattgaaactcgaccagggtgcggatacgctcggtactttttgagtggagagtcatctcctcgagaggggctttctgacgtcgagtggttagcagctttcgtcgagtgctgcgcttccccttgagcttcagtttcctcagagtaggcctggagctagctctaggcttggtctcagtggccatcaagcccgtaattcgttttttctgagagcgcgcgtgttcgtcatggaagtagtcgtctctatagtcatcttgaccagactcagactctgggcagcctgtatcaggacctcctttacgcttgcctcctgccagctgcacgggagttgagaacttggccttgacattcgctatgcagcccccaagtctcgtcgccgcagacgatttgcaagctttagaacgtctaggcgaggcgatggtcctggttttggcagcctctgcgagattgtgtatgctgctgccaccctggacgggatatccttggtcttgttgaagtcgcgctccctcttcctcctgggcctgggagtcggtgttggcttctttgcgaatttttaaaaggtgagtacgctcgcggatgcgatcggattggcgagtaggatggtgcgattgttcaaccatgtcgtttcgaggtgaaaggtgttgtgagtaacggatttttttttctttgtcaattgtacgattctgcttcaagaaagggacagaagatgcagggaattgagccgctgttttttatctaacgacactggtccgatcgcggctttcatccctgctcaaggagcgacgttagagccgaacgcgaaccatggtgatcgaatcacaagccggccatttcaactgctgatgaatcaagcacaaagccttagagaggtcaagtcatgagcatagccacatccaagtctatcagcatggccttgcttgtagggcagcagctgcgcaggatagtcggccgggcttccagctgctttgaagcgaaggagattttccttggccaagaatttgcttgacctccattcttgcaatgcaattggtgccccactcaatctcggtcgcccgcgaagcagcaatgtgaaagtcaccgtatttgtgaagccttgaaaagtccgagctgccacatttgtacaattttggcaatttgcacagactcttcatcgtcccctttgcctacacctttgcctagaaaacacccccttcaacgtcgagctgtcagctgcaatcacaggacaatgtatcagtcctaaagtccctccataacacccgcgttgatctattgttttggtggatgcgctcggttctttgattttcagcagctgatctgacgaactcgtgaattctgacgagcaaagcagagcagcgcaaccattgtcgtcaaggcacacaaatccacactatgccacaccaaatgttctttaaagagggtggacaagcactacgaccttcgttatttttatagaaacagaagaacggcgaacaagggctacacatatacctggccggaccattgatcttggtagtgcacggggcaagtgcagtggtaccagaaagatcaatgaaaaacggcgcttttcgctcctattccgggaccgagcaaaacaggtgccccagtccaaggacacggttgttgcatatcagcaagaggagggaggggtcgaacgacccgtcgtgattgctttgtggaacacaagtgcgtttgtagctgtaagaaagaacccttgcttctcttgaacgatgcgactttgcagccttccaaaccggttcgtgctacctgccttaattctttttcacgactgggagtcctcataatacagccaaattcacacttcacgcgaatccgtcatgccctcgcataacccaactatcatactagcatttcggtattgctcataaactcttctgctcctcatgttcagtcctgcccagtcatgccaggcgcctctttcctttacagaatgaacgctatttatggaggtcagtcaacatctttaggtgcttgggagtgctcctactggagggtgaaatcggaacgcacgcatcctctgtatacccatgcaagacacaccgtgcaaaggccatccaccataagcacaagaaagtataaaaggctgattcggctcactttcttcctttcctacaatccgatatcaaaagacattgctacgacttcatcagatagaggcttaactgatcacacattcacccatcccccgttaagcacaaaaaaaggaagcagtgtagatcctcctctcgttctactctctactatcttcatcgtgtcgcgagaatgaatccaacagtcggcgacgagcgcaagcaatatccagctttagaaggtcttggtgaaacatcctctcccgcgcccttctcaggcgctgtgcccagccatccgcagcacctggcgcagggtgacgcgtccgctcctcaaaatcctttcagtcattgtcaagatgtggctgccttcaatgtcaacggtgccacgctcttcagcaaagagatggttatcgactctgacagttttctctactttggtcttgagcaaggactcttctatggcggtcccataccacctgcccgactgcctcctaacgatgcttgcgtcctgcctcagcagtatcagctccagccctcggccccgatgctcaagtttcagttcgatgacttgcatctgttgcagccgctgaagacactaccatctcccgacttttccgctttgacacaagagactgccggttttcagcatcaaccccagtaccttgccatgcagcttaaatcttccttccagctaccgccagagtcgctccaatcatacaaaaatgtcttcgcagagactataggcctcgatttttccacgtgctactatccgtcttttgagcggccccccagcccagacgattcagtatccacgggctctgaacaaggttatttcgacataatgtcagaggatgggtacacctacttacctgcctcctcttactctccgaccatggcaacctttggtaccgaaagcgactttttgatcaagccatttggccaggctggactccctctcatgcctgagggtctctcgacttcgtccgcagcaatcccagcagcgggccttcattcgtctgaccctcatctggtttacagctctttttcacaccccttacacagctccgcttcggcttcgcacgcatcctcgttaccggccttaccttcacctttgaagcagcaattcaccggatatatgtcggatgattccaatgactctgaaggcgagtccaagccgaagcgcaagaagcgtgtccggaaggcaatggcaatcaaggctcctgccaagctcaaaagattgaagccagttttacgtgtaagtatggaacaaactgatccataaatgggcggcctcgccttcctgcccagtctgaccccacctggtgtcgttctccttcaactacatccttaacagtgcgagtttcctggatgcaagattacttgttcgagcattccttcgctcgcgcgccattttgagacacacaagtggcgcggcaagtactcccctgtacgctgcgaggcatgtcagaatcctttatccaacgagttctcggtccaacggcacattatgcgctcgcctctgaccaccctctgtcgaaggatgcgcgtctacagcatcatgcggtctgccacagacgttgaagctactgtgagattctacccgaagagaggtcatggcaagaagaccaagattattgacctagacatggtcaaggagaagtacttatgaaggtttggtttcaatatcatcgattctttaccctatctatctttcacaccttgcccaatagtttttatcatctccctactccactttgtttctctttgaaccagaactgttagtcagagttgaacttgagaagcgaaccgtctttgaatacctttctaattgaaataaagccgagaaatctgaccatgctgtgcgtggatttgaaaaatagcacccacttgctattgaaacccatataagtcaactcggacccatttcggtaataatgtggatgagagtctgagagaatgccattgctccttcgccttcgggaaagcgcggggtgtggtcgcatccatgttcaaaatccatgcaaaagtggctcagacacttcaaaaggcaacgcacggcgccgcaccattgccatgagaaaaaagcgccttcgcagagctctaaaaattttcagcaatacgcttgcgcctttatggtgtgcgaacaaatccctttggagacgaccctgtactgcatacaaaagtacactacaatgggagttcgtgaatcctacaattacacacagttacagcattcatcgacacacataccttccctctcaagatcacaagtattcgtgcggcgcaatgcgtgaaatgacacacaaggctggaccgagcacaagaggcagccctaaccctcgtcctggagcagtacgaatctacagcggttttagcaagcagtctcgatcgttgcatgctccgccatcggttataagaggtgatccacttttgcccgccatggcagagcttcaaactggacggtacgtcccagatctatttccgagagacccttggatgcctgcaataatggccatggaccgagttaaagagcaattcgcgttgagagaaccgtgctacctgcacgacgcctcgtgcaggcaatccggcggttatcatgagctgcaaaacttccctcctgagttggagacacaaatgtgggaaacctactttgcgcttccaccaacgcaacctagtcctgctatctcctcagtgcacgtaatatccatacccgatagtccagccgcaaactcaatcatgagtgaggatcctgacctggcgactgtgtgcgcaggcgcccttactcccgataactatggccctcctactctaccacacaaagtaacggagccacgcaccagacgcttctcagagcgcatccgagcccgcgagcatagcctggttcctgtaaggcaggccccatatccgtcacctaaccctgacaaacttacagcctctggatcttcagttttagttcgaaaggcccgctcacggtccctaaaaatcagctctggccgccgatgtgacatcgcttaccgacccaaaagtcatcccttgtcacgacaatgctcttttcacctcgaaaaagacgatccatcaaaaagacttacagaatcgaaatgcggagaccggcgtcgcttccaatgtgttgcgtgtgcggacgggctcaagtataaaacgttgagtggcctccagcaacacatcctccgcttgacatagcgggattgtcttagtagcgggctctacgccgagttcgatttggaagacagtcagacctggaaggtcaaggcaattccgagggcttggactcgagcagctgtactcagctttacgctatagtaccagtaatgtgagcagcgagcatcctcccgcggctcctccttcagaaatgaagatgggcaccaaggtgcaaaccccagatgcattcatctccgatttttttagagtcctacgaccattctgtggcctgtcaccatttttcatccatctcttccccttttccttcctcccatgcagaatagagagcagctttttcatctccatctcgcattcaaactccctatcaaaaaaattacgcccaagccatttcccattcaaactccttgcttccattttacagaagagatatttacacgggtttatttttttaaaacatgacaagctggcaacaagaacatcgcactaaagaagatttttcgttatggggtaagagaaggggtatacacaggtagagagtagttgcatagtgtaaaagggaaaaaaaagaggggtatatgcttatgctgcgggtgaatcaaagatgatgcgctcacttctttctgcgtgcatcatccagatccgaacgccttcgctttctgtcgtcaaagaaacattcctcgttatcgagcatgtgcagaccatccgccacggacatcatggacattatcatatggtcgttgatgttgcttgtcattgaagccgcgttgacagcagcggcagtggcagcagcagcagaaaccgcggcctccctttgcagcatagcagctttggatcggtcaatctctctcctcaatgcggtagagatcttctttcccattcggctcatcacctcgtccaagggcttggcgcgataggagctgatctcgtagtggacctcgactccattggtgattttgatctggccaatggtaccgatgccgcgacaaattgaatccatgggagagagattgatgtgtcgcgtcacagcatctcgtcgagagagattggacttgcaacccccacagttccagagcaacttatcgtggatcgactcgatgtggcgaacaagaaccgcgggtcctgcgaaacactgaccgcatttggggcattggttactgggtgtggagctactgatgggagctgaggtgctctgagtcgaggtggaactggcagcggagcaggtcgaggattcccgaaggtgagaaacacgtctctgggaacccattgaggaactggaagaggtcgagtacttgcgggaccggttgatgccagagacgtcagacaccatccttcggacattgcactctgagcccctgttatcacttgacattgagtgaatgtacgaaggagaagtggccctggaggattcgcacgaggcagtcaagtcggaatgggcgtgagaggacgatggtgacgcaaatactggcgtcgatgatccagacgagaaggtcgagtcgacgggagaggacacaaggccccacgaatacgcctgctggccgttccggataatgttgttggcagcagaaatggagggagaggcaacggacagtggcaaagggacagcgacagactgagtcgaggtgtaagatgcagagtcccactgcatgttgtcggaacaagactgaaatggagtagtgcttggatccgactcggtcgtgatctgaagatgaggttttctctgacggatacggtgtgcctgagcatttcttggacggtattgcaatggcgacatcaaagcctgatgttgaccgaatgggtgcttgagctgaggcgaggtggccatggcaagcgagagctgctgctgttgatgttgttgatggaaatcgaaaacagtgttcatcatgctgctggcgctgttggcgctgtaaagagggttggttacgctccagccggcgacagtaggggattgattctgtccctgaaacgtgttggacgagtagtggtagtgcggaggtgagctttgatggtgttggttgatgtacgaacgctgctgctgctgctgtccgccagccacgacataacccatgccgaacgacatggaggggacaatgggcgttgatccctctacttctgacgtgaccgaaggagagctgaccgactctcctgactgtgatgatgttggcggggagagaaggaacgaggggttgctgttactgctgttgtcgaactggctggtgttgccctgaatccgatctgagggtaggctaggggcggctgtctccttgaactcttgctggcgtgaagggctaggcgacgatggtgacatgatgcctacggagagttcgtcaagggagttgctgttggcgtagccggagtcccttcggacgttgatgatgtctgagttgttgttgatatcgagaccaagaccatgtatgtagtcgatgctattgctttgggcggtcgacattccaagcataaccggcacttgcagtgagttgtagtaattcatggcttgctgagaatgttgaggctggtgttgctgttgagcgtattgatggtaatgtgacattctacgttcttgcgtgtggttgagcgtgtgtgagcgcgtagagggacgataaaataacgatatcacggagaagaggagatcaaggggtgcaagtgagaaggaggtcaggatagaggtgcaaatacagacgatttcaaagaagaagacccgattagaaagtagaatagatcagggcagtgggcgcgatagaagagaattgagattggcaggaggtcagggagctggtgtttatacagagaaataggcgaacaaatgtcgttgggcttaatgacgggtgaaagaacaaaaatatatagcaatgaggaacacggaggagctgtacaacagaacggagagagagatacaacgtcagagaggctgatggacagagaggatgaggagggaagagcaaggaagtgcaaagtatttattactgacggatgatgagagtcgacaaggaagtgaagagaaaaaaatcttcgagaggggcagcccggcaagggaatacatttatagcaaatcctgttgcgactcggtcctggcggacatatagcgcacttccggtgtagttattctaaccctattcaattgctcgagcatgcatgcacgggagagcattgcatccatcctcgttcatctttttttttctctccgtccgcctgttttccatagttgaaatgctcacccatgcacgttcacacacgcacacacaccgtcacttacactatactatactacactttactttaactaggtcacccttcatcctcatcagcaccttgcatatcactcaaaaccccttccatctatcataacctgtaacctcacactacatggacccataaaaaaccaactgcaaagttagatgcaagcaacataatcactcaatcgtcacagcctgtgagtccaaagcccttgcacgcgcacccacatgtaccttactcatcaagtccttgattcttaactcccacatactctgtggtgcttttaatgaagcagtgtcaaggcaagggccgcaaactgcatagacgtaagcatgctttatgcacagcaagggaagaaggagactcaccgacctatgacgcctctcaaggcccagccctttccgacgattatctctggccgccgaaatggtctatagcaaaggcgcctctcagcatcgtcacaccatcatcgccttgcgactagcaaataaaaaagcatctattcaatgcgaagaaggaatgtaaaccgggctaattgtagaatttgtatccatttcagccatttgcgctcaagccatccacgagtccttgatagtcgagcacacgccacctttcacagcagaaataaacgttgctcaactcaagtaaagcttctgagccgtactttttaaaatagagacgatatgacatgggaacagccaggagcataatggctgagccatctagaacaggcccttggatggactgggatgacaagcgcggaccctccttccccaccccttgacacccttgccctcaccgtccgtactttgtgtgccctttctgtcaaagtggtcctgcgaagacctatagacctttctaaggttaaactgtccaattgagtagttttttgtcctagtttcccagtgcagggatgatgacggtcgaaaatccatggaggtctggccgttatttggtctgggtgccatttttgcatcatgaagacatcgatgttgaaggggtcgaactggataccgggcgttattttcctggagttgaacggattgatgctcccctttgtgcacagatggatcattattcacctagtatccacgcgactcctcaacgcgtttgaggttagtaatggtcttagaaagagagtattacaatacagctgccatgagagcgattgtcgcccaaccctgaagtagagtgtgataacggaacgatttcaattactgcgtgtacccatgaaccttttcttccttgctgcttcggtgtattctacgttgcttcgaagggagtgtctatttttttttagcactgtccgtgagccctatgttttactcttgggggcgactgagagcattctattgaaaaagtggtgtagtcacacaatggaggctcatgatcctctttaccctctgaccctttttttctcagggtacgggagaagtgtgcctcaaggctttgatgttgggagatgtttgtgtttgtcctcccactgtatcacaatggagagcccttttcatttagagttgatgtgcatctcgggacttgcgcaagtggccatggctcaagggcctatgatcctgtaggcatcaatgcgctaccataggtcaaacaaactatagccctggctcctttggcgtgcccctgctccttgccttttcaccctgacgtgggtcctgatactattcattgtctgacgaagcatcttgtgtaactgcttctcaccagattccttctctatcgtaatatattcacgctcatgccttgcaatgccaccctctgcttgatctaagtgacccagtcatcgagccctagcgctctcttatctgcacgctctttataagatggaaagaattgattccattcgacacctttatcgagctttcggcataactgcgtgatcctcgacttgacacgaatgctcatgctcacattcatgctcactagataacatctaaacaaaaaaacaaaaaaatcatctagcataagggaaaggtttcgggagggatcaagatgttagatgatcatacctgccctgtaagaacgacgagcccgcctggatctcttcagtatttgctctcaagcatcctgcctcaagcatctctccacgcatccccttcaacgtgtcaaagagcgttgacaaaacgtcggtatattaatagtgaaaatggtccgatgcaggcattcgtagcttgtcatggatatagacatgcatctcagtttccattctatcgagatgtgtagtatgtaaactagagtgttcaatttgaatcgaccgaccactgagcgcgtcaaagaaaaaagtgcgccaaaatgaacttttgggaagcatggacttgcatggtcgtccttaccagttcatccgccagaaaagcaggatgtcctcccttttttccctctctttcttgtacggggtttctccccctaaaagcgagaacaaacaaattcagccctttatgctattaaagtccattttcgctaaagaaggaggatataaacgagcaaacgatggtcaagcccaaagtctccatgttcaaaagagggggttattgaaaggagaaggaaacacttggacaagaaagaaagaaacgtcaacaacgacaagggcaattagggaaaagaaaagagcagcagcaaggagggaaggctctccaccctctttgctctggcagccgtctagacaatcaacaaggaacccgacagaagggattgcttcgccattggaagacaatgccctgcttcgagtttgacctagtctttaccacacataaacacgcccacacactaccatcctatccctcatttttctggattgagagtagtcggcgcttcccaactacaccatgtcactgaactatgatccggtctcagaattcatgcgagaggaaagaaatggcactatgtggatcaacgtgaggatgatcacaagggttcataagtcctctgtcccctttctccccatatgctcctggatatctgtatcgcggcgtacagtcttccacagcacgagagatacttgcgtgcacgacatggttatggccgacaggatacaacagatcgggagaaaagtccttccccttgctcttcacctgacgataagggtgacactggcgcgagagcggaaggtccaaccttattttgaactgggtaattttttactcgtttgcgcaataccgcattccagcacgcgcgttacacgtaaggttacatggcaacgaggtcatgacagcaaaaaaaaacaaaaaagagccgtgtccataaaagtgcagatgattgtttgtgcgtttgttgttgtgtttttgtgcgcgacctttggtgtgcaggcaagggacttggactactggtgaccctgagatgcagaagctcgtaacagaaactaacagaaaaagaaataatttcaacgaacgatagaacctccttcaagggtcaccttccttgcttccttctttgccttttgccttgtgctcgtccttggacttacgcatggccgtatgcaccccatgttgagcctgggcgtacatgcggagtgggaagcgagggggaaagaaaacaaaagaaacgtaaagagccaacagtgcgcactgcccttccctccctgggactaaaatgttgccgctctcacagggtccttcttgcctgtagaaagtcgccttccccttttcctctctccccttctctccgatgggacccctggaggatagtaaattacgtttgatcatgtatgatcacccgtacggcgaaaaagcaccgtcattgtctcctttgctcactcccttccttctcccaatgcatgtatcgttgtagagcgataaatggtaggggaaggaacatctccttcctcgccatgttcatcgggcctgtctggaccgttctttagtgcagctcccgatgacggctttcttgtttacgttcaagcccgttatttctgtaggatgcgaaacacgccaacagtcaacggtaaagtgcaagaaggagagagagagagaagtgagggagagagtggaagttagaatcctccgtgggtacttcgcccctcatgccaaggtgcatatcacagcacgagtgggtaaaatggcccttgcgttcgatcgtattgtagtcgcacagaagcccttctactgcaagaaggtagccggcctctccaatcaaccttctacgtgtatggccgcctgtgaggaaatcaaaatgcctcttctcgccacgtacaagcaagggttcttggctgcaggtgtttcaggtcgaggacgccctgcagcctccctaattcttgccacatggctctcgtacacatcaccactacccttcttttcgctttcgcgcgtcgcttctcttctcgtttaatatgatacttttcttgaactcattttccctttgtcctcctacagacacagaaaagacgcgatagctttgtttggtcatgatgcacaaaggggcggtttccgtgcatgaagccttatattccaactcgcaggcaattctcacagtagtctcaagcatgggatcatggtatgactagcagtggtcgacatttgcatgtctatacctcacaaagttcggggtcaaatcgcgttttttttcacgacgtgtctcagactgaaaaacgtgtcaatcagcaattagcaactgaaaaaaaggccattaaagacgtcaaccagggaccgtgtggtcaaggccagactgtgcgaataccatcgatcagctttttgcccaatgatccatttacaacagagaagaactgtaaacacttgaagcagcctggcggccttgtttattgtactttcgatcgactctcgcctgacgcactgacagctcctgcaggtgatgacgacgttgttcctgttcctgctgctgctgcctcctctgcctccatgactgcactcggcttttccaaaatctcaacccctctgatatcttcacaccatacgcccgattccctgcccttgctgtccttgcctgggaggattgtgtaagtgttaacatatttcatcaacgcccggatatcctgctttttcaagtcgaattcctccgcgagttggtcttccgtccaaacagacggatcccgattgcgcagctggagcatttgcatcagcttgagagatgtaagagtggtcgcagcactcgcagctgttgacaccgtgggcgaggactgagcaaaggtcggtgtattcggtgatgactttgagggcaacttgcgcttcaagatcgcttcggcctacaagaaacgaatggcattcttgagtgtcatggcaaaagattggttcaacgactaaaaaaaaacaagcgattctgcaatggctcgttgtcgtacctcctggtgcttgatctgatcaggattcggtacttggacctgcccaagcgtctttagatttccaaagaactggagctcggctgccgacggcgtgtcctctaccggcctagtctccccatctgatatgcgaatggagtatatgaaagaaggttaatatgcagtgtacagcgggaaatcactgcaaacaaacatattgatcagtccagtgctacatagctgtgcaagcatagcataccaagttttcctgatttccgcaactccttgtcgtatcgagccagctcttcttcgagccgcttttgctgatccaggtagtcttgctttggagagttggttgtaggtacccgccctccttctctggctgaggcagctttggtagctcctgctgcagctttggaggatcgctcgtgaatcacattggccgaggggaaatgacgagctgcagctttagcggcgggagcagcgttggacgctttggatgcagagcttcccatgccgcgaggtcgatgcaaagtgtacgagaaaagggggggagagcgaaggcgaatgtggtcgtggagagagcggtggtggtggtgggatgcaggtgatccttctcgggatgcagccattggaaaaagtccgagcaagggcgcgttggctctgctaggaacaagccacagaacctcgccatgaaccgcttcgtgataaaaatgaaattcgtatattttcgcaacaacgttctctatgaactcactgtctgacaatgtccttggcagcaaagttgccaaagagcaggttgcacacaatctcaatggcccatgccacaaagtagtcgaacgccataattccaatcagcttggtcttgaacgcctcggggaagggcaccagctgcagccactcgttgaactcgggcacaaactctgtcgcacctgcaacagccactcctccaacagccaacagaccgcggtacaaataagtgttctccttcagactctcgcggaagggatggcccttgtagttgatcgcaaacgtcgagacctgcatcgacagcgagatcaggtagatcgcagagttcaacaggccaggctcgaacgtgcgttcgagatcaatcgtgcgatccgtctcaatcagcttggcctcgtgcgtgatatagatgagcgagataatatggactgcaaactgtcccagcaccgaaaggatgatgtaaaagttgaagatgttgggctgaggccgttccttggacaagtgctcgagtggtgtggccttagagatgcacatgaagcacactgccatgagcatgcctgtgatcgtcacctggaagtctccaaacttgatgccgtccaggtacagcacactcagcgagtaggctgtgatcagacagttcagggccaagatcttgtacatctgcatggtcgccacgagcgtgcagcgtccctgccggataatgttgacaatagacataggggtcgagagcttggacgtaaagggagctgctgcagaggcgtcaccgagtttgatcgtgggaggggcttcctcgtccatgtcttccatcatgttggcaataccatccatgtccagctgggggcggggtgggacgacaggccgaccattctcatcgacagcaccaattccggcagcctcgcgggcagcctgctgcttagccgcaatgacctcggcaggataaagatgagcaatcttggcgtgaggtggaggaggctgcatgttgaagcgggcagtgaacttgatctggttctcatacacgttcttgagtcgctggagctggttgtactctgcaattttgacaagatcctcgggctttccgtccaaaagagcgacaccaatgtgcgcctgcttcagcgctccaacatcgttggtgccatctccgcacatcaaggtcgtgtacccgccagccttcaaggtcgtcaaaatggtctccttttgtcccggtgacacgcgagcataaacccaggtgtggcgaatgagttctccataagtcggtttgttctcaaactgcgccatggcaggtcctgtcacacagatgtcgtagtcgcggaagatggtggggtcgaatggcttggtggggtcgagatcaatcaccttggtctcatcgatcgttttccagactaaatcctcggggccgcttccgtcctcgcggacgtccataatcaaaacgtcgcggttcacaatgtcgacctgacgggccacatggcacgctgtcaagggattgtctccagtgatcatgacgcagcggtgggaagattcgttcaacatcttgatggcctgagcagagtcctccttgagcgggcagtggaataccaagaatcctgcaaagacgaggtggctctcgacgttgtcgcggttcagggcattgatttgatcggcgttcaatccatcgggcaagtacttgtatccaagggccaacacacggcttccgcgacgagtaaactgtttgtaggtatcctcgtagtgcttggggagctgggtgtacatgttctttagggtctcaggagcgcccttgacagcaacaaacatcttcgtggtgcgaaactcagggctggtaagggtggagacagtggacatgcgcttcaatgcagacgaaaactggaagcggcggcgaatcaccaaatgctcggacttgttgtaggggttgtcggggtaaacattatcgtgcttgccaaccttccacttcaaagcctccagggttactcgctccattggatcaccaaccaggccctcctccaactgaactagtgcatgagccgtggcgaggacgtgacgcgaggacgcgggggtttgatcaggcatgatcagcttctcgggctcgtgagcatcgattccgcagacaccctcgacaaccagatcctctccagtcaaagttccagttttgtcgaagcagcagacgtcgacctttccagcaaaaggaatacggaagggttccacgcaaaagatgtggtgacgggcaagtgcaatcaaggacgtgttgacagccaacgacagctccatagggagctctggggggacgaccgaggtgatgatcaaaatacaatccagtaagagctttccgcgtttgcgtccttgttccgtaccgacgacccagacatagtaggcagctacaatggcaaagatgagcaagaagaggatgaagagcagagcctcgagattgttggcggtaacacgttcagtcgagtagaccatggtgcggaccagctttccttgtgcagtgccgaatccagtgcgtacaacgtagcaaatacagccaccgtccggggccttcagtgaggtggtagggggggtgacctggaggaccttggtgcctccgtaaagaacattaagcttgtcagcgccgtttagctccaatacatcatcagcctcgcgcagcatgatgccctccttcaaaagtggtgtcgattctcctgacagcatggcttcattgacaatgcagcttccgtccacaatgaccatgtcacaaggcactcccgagtcctccttggtacgcacaatcgagaccagatctccggggagaagctcatcagacaggatgttaatccagttgccgttgcggcgaacattgaggtggaagggcttgatcgacataccctggaactctccaatggttctcaagcgctataaacacatccgatgtagataaaacaagccagattgagtatctcttagtttgcacgctgacatctgtcactttaatgatcatcgaccagcagcattgtgcctgcacaatgtgacgtcttacctgccaaaccacagtggactcaaagatgacgagcatgacaagagtaaagagagagtagtaccagtactcgtccaggcaccaaagagcgacgcaaaagatctggaagatgaagaatggtgcgactgcgtgctccttgaagagctcaacaaatttgggcagggggatgtcgaatcggttcatgccgtaggttgcagccgatgccttggtctgttcctcggtgagtccgcgagccttctggaagtcgcccatggtgagacccaggtccgaggggtacttgattttgacaaagatcttcttgtcggcattgaaaatgtactttttcttctggaaaaagaagaaaatggctccgttctagggtgcgtaacgatggggcgtgatagtgatcggttaaaactcaaaaaatgaaaaagaaccagtcatcacttgccaacgcaacgccctcaatccggtttgaaggatacgctgtacatacctcatggtgaagatcgcacaaggcacccagtccgcggtgcttgtcggggatgatacggatgatggttgccttggcagggtcagtttcctgaaacaaaaggtcgtcgagatccggttagttatcagtcaaggttaaggcaggatttgatgatccaaacgagaaacaaaaagattgtagtgtgccaaaagcgagaacatgaggtcgcagcagcctcttacctttctgcaggtcaacgaagccttgatggagacgctccactgacaagtcaggaacaagagcgagttgatggtgaggagcaggcccagggtcacgaatgtgatctcttctgacttgatccaatcgtcatagtggaagaagtagacgaaggaccatgcaggatagaggaagaaaaagggccagacataggcgtgttggatccggggaagacgagagtgcagcgacgacgccacaatcagcttcgtctggactagggaagccggggccctggaggtaatcagatgttcaattcacaactcacggtgagtgtcacagcagcacaactcgggtcatcaggaacaacagcataccaggccggaggatgatgcgtgcctgcatctcaacatagcccagagtaaagcacgacgatagtcatgggaggtggtgttgactcgttacttacatttcagcaggttgaatctcgtcggacagagcagacagcaacactgacgagaggaagctatgcagacgaagtcaatggaaccattagtcctctgcttgtgcacctgcttgtggactgatgatggccgtgtccattgctgcgctatcccactgctcgtgcatgcaaaaatgaagtgggggactgcagctgtgctattaccaaggtgatgtccgttgagatggaaagagatggtgcaagaaacagagtcgagtcgtggctctcttggggaacgatgaagaagcacgcccccgcccgatcggatcacgtgctgcatgttttcctgagtactctgttttcttgaacgcccccaattccaatggttcacaccctctgcactccctctgcatcccctccgcattctctcacaatggccgcacaacagattctcaacatcaagtggctcaacgccctcaactcaaagaaggtcatcctcgcatcgtcctcgccccgacgcaaggacattctctcgaaccttggtatcaaatacacagtcgtgcccagcaccttcccagaaacccttgacaagtctctgttcagccatccttcagaatacgtcaaggagaatgcccttcaaaaggctttggaggtctatgagcgcttgaaggtaaagaaggagcgctgttctcagttgttttcaaaggagctgcatcaatcagtggatcttctttttgcactggcggtgatatctgactgacactccttcttctcaatgcgactgccaggcgtcaggcgagacccccgatctggttatcggcgctgacactgtcgttgcgctcgggtctcaaatccttgagaagcctgcctccgtccagggagcgattgacatgctgaccagtctgtcaggatcaactcacatggtgtacacgggcgtcactctgatcgcgccacccaaggatggatccgacaagcccaggatcctgacagatgtcgagggcacggaggtcaggatgcaaattctttctcgcgagctgatcgaagcctatgtcgaaactaaggaacccatggacaaggctggagcgtatggctaccaaacgactggaggtcttctggtgaagggcattgatggctgctcctggaatgtaatcggtctccctgcttccaagcttttctttatgcttgaaaagttcactacggagcagtgatcgatttgtaagcacgtcaaagaggctcgatcagcctcagtagaacataaacgcgtgatagatgactatgccttatattttctctatatgctgatgggtgactgactacaaactgggcggcagggtaataaagacgggctgctggatagaccaccgatccgcgaagatcccgcatcgattccttgcttagatgatcttgggtgtctgagcggttgggctttcaaagtcccaaacgtgctgtatccacgatttcatgtcaacctcttcgtcagaccgttttgaagaatcctcgatgaaagggtgcttcatgatctgctcgggtgtgggcctcttcataaagtccttgatgaaactagataccagcgcaccgtgttaggactctaattatgttacaatgacaccgaaatgcaacatccaagagataaatgcttaccactgattcaaaaagtctctaaagtcgctcgaccatggctcatcctcaggcagtgatggaacaggctgattgacaatgtaatgcaggagctcgaaagccgcgaggttttttgggaaggggttcttcatctgtgcaatctcgaccatggtcaagccgagggaccagacatcagactggacggggtattttcctccctgaatgcgctcaggctgcatgggaccatggagggaagtgtgttagtgcctgctaaatagattaaagcgaccagtccaatgcctcaaatgcctgatgcgatccttacagccatatagtaactggttcccacaaaagtctccgccaaagaattgacgagatccccactgacaccaaagtcgcatagcttgatcctgcccgacatggtcacgacgatattggacggctttagatctaagaacgacattggaaaatggcgcggtgaataggcacccacgagaacagctcatgcacgttcttcaggttgcaggtccctgccccgcattgtcgcttttccttacctcgatggattacgtgatgcatcttgtggaggtataccaggccattgaggacggcctcgctgatcttgccgagaatgttctctgatatcgtctgacccttttcagccacgcgcctgtacactgcgtccatgcttcctccttcgcaatactccatgcaaatggccaactcatcgtcttccatgtaagcgccgtaaaaagtcacgatccaaggagaatggcatcggtctagagtcttgagctcccgctgcagcagtctctggaagtccggatttgggtcgcaccgaacgtgctagaagccatttgaagtgttacaaagcgtcactcggatgcacctcgtgcgatttcctcctttggctgataaggtgcaacccgagacgctcaaaggagagactggaaaacgaggagagtaaagaacaaacgaattttcatggcagcatacctttcgcgccatgacaaatcctgtagggacgtgctgcactttacacactgttccggcggatccctctcccagctttttgatggtgataatgtcctcggggcgcagggtatagttcatcaaggggtcgggcccgcgggtgcctcccggtgtctctgggatgcttctgatcgactgcgtttccgagtctgcccctgcggctatcgaatactgagtttcgcgcgaagggtctcgggggttgcgttccaggtactccatgagaggccgctaaagaacgtgaaggcaagaatgaattaaaaaggttgtttgggcaacgagacaggaacggctgcggacttttaaggatacctacgttcatgatgggtgctggagacggcgcaacagagtttgcggatggcgccttcagctgcacatgcagcgcaggcttcatttttttagcatgggatcttgcgagcgacatgggaacgggacgtgctgcagacgtggggtatggcgggtcgtcgagtgcacgatggagtctaggggatgaaggcgggtggagggggtgaggacgagggaatgagggagcgagcgagacgggaggagaagcgaggatgagagagtgagagaaagagagatgaggaaaacaaggacaagggaaaagaacagaaaaaaaaaaaaaaaaaaagaaaaaaaatcaaaatcaaaaatggctatgggtccaacaatggtctaagggcgtccgtcgggacggggactgctctggctaacaagagcaacacccgcggagaagttccccacgcaggccatggccatgcaatatccgttttaagatttcatttcatcgctgatacgtgctcgctcctgggaccctacggcggcaaggcagtgctgccgtcgtgtctgtcaaggcgtgctcacagggcactgccctgtcaccagggtccacaaacagggctgacccaatcttggaattggcgctttggagtgatgtccagggcgatgaggccgaatggcccaccacgcactcaggactcaccgctcgctggcaagtccacgcagggcagtcgccattgaaacgccagtgtgaacacaaccagaagactcgcacgccgattgtttcaacgcacacttgtgcgtcggctggactgcgtgcccactacaagattttcaggaacacagccctttgttggatcgacaacgtacagtaggatgcctaaaccccatgcactcctagcaaaatagcaaactgaacaggcgagagtgacgcccacatcactgtgttctcgcgctgctttcactctctctcgctccctgtagccttctctctctccctgtcgccctctctctctctctcactctcggacagataagaatcgatctttgcaagacccaacagcaaaatggccgttgaagcggaatatgctctctgcaagccatctgtgtttctcagtagcaccattggcttcagctacaactatcaacaccagctttctctcttgtagctcactctcttcataaatacagataacaagtctatggcacgcactttgtgaaagaatacatactcttgcagccctcaagccgaagtatcatctacaacgcggcagagcgccgactgacaaggagataccctctatcactctaccaatcacgatccatcaacagcacgtcagtgcactcagtctgctactccagcaaaagcagttcggcagtagcgtcagcttctaatttggccagatcggctccagcatcatctgcagacgctgctcatctcagtaaagccttctcgatgtctgcggacttggggttgctccctcatccaccgacgacgccatccaagattgcgctgcagggtaggcatggatccaaagtattaatatcgtggttgtgcagtaggcagatgggatgatccccttttctcgctctttgtctgtcccaccacagcggttgtcatccattggacagttcgaaggtagcagtgcacttgtacaggagcgctgtgcacgagtgcaaggcaggcaggcagaggtgtgatatttcagcctgcccctttatttctgagaacaactgacttggggggtggtgtgcggactgactgactatgatgcccgtgaggcatacgggtcaggtagaaaacgctgctgaacgcgggaactgttgaatgcgctgcattcatccacaatcacgcattcgcccttgctcctgtcctcgtttctaacccacgttgctcattcgacaccagatcgccccactcaccgccgtctgcggatctcgtcgccgcacttaccaaggctcaacgttcacgtccccgaggtcagtgcccgttcacaagggcagtctagcagcagaagcagcgccagcacagaaggttactcaacccccatctcagcctcgttcaaagcacgaggccgtcgagacagctggagtccctcacaggcgatccccgaaggctactactccaaaggcttcacccttacctcgtaccacaaagacaaagcctccttcacgcctttgtttgcgtcgccgttcgcctcttcatttccgacacatccaaatacaacctcgacttcaaccgcagcaccatcctcaccactcaagcgggccaatactcaccggctccagcgcaaggagaccttggcaccgttccggcgactcgtgggtcgttcgaaatcgttgaagcttaagcatccttgctcgtctagtatgagcactcagatcatgccgtctaacgtagaatacgccaaagttttcaacagcaaccacaacagcggtcaggacgatagcagccagcccatgaataagtttgctcatctcgatggagccaggagcggtgcggatgggaactcgatggacgagtcgtgtggtcatgggaacggtattcagtccaaggagaaaacggacagtcctgagcacagccaacagatgttgcccgtgtcagtttccgctcgtccaaagacggctggattcatctctggtcccacttccgcacaaactgctcctgcgacaaagcctacaatcgcaacactgtgcacgggtcccacaaaaccgctatggcagcatacgaggacaaacgccgaggagatccttgcattacagcttaccagtcaagaggtccagaaacaggaaacaatttttgagctcatctacacggaatccgaatacctggacgatctcaaaagcattcacaaggcatgttgccctacccagttatgctctagtagcgaataccgcagacgcgtcgctcacatctcgatcattcacatgtcgttcaacagattttctttgaagaactcaacatcaaaatggcagaagcacggcgcaagaagcgatcgagtcctgataaggcggacgtgaggctgtacgaacgtcttgctcggctgctgtcccacatcaaggacctgtggaatggacatcagtcgctgttacgggtaagcagatgttcgatgtcttagtctttgggcgctatgtctggcttgataccaacgcatggctaaccgtgtgcacgccgtcaatcacgaaatcccactaccagtccctgcagaacaaacaggatcaggagaccccacttgttcgaaatataggcagtgtctttgagagcgtaagctggaacacactcgccacttattcgtttaacactgggtccatctgttaacaccttgacacctcttactacactcacagttttacatgttctcgatatacgactcgtatttcgcccaatatgcgacgacttcacgagagtttcagcatgtcataaccggaaactctgaactgtgcttgattatcaaggtgcgctgcgcattcgcctcgttctctgtaatccgccgacctgctgttaacagtgcgttaactttgtcatgactctgtcgttttaggagctactgaagtctccacgctgcaaatctttaactctggaggggatctttctgaagcccattcaaagactacaaaagtatccgctgttcttcaaggtgagctccagtgcatcaccatgttgcgttaaagccctacagtgcgtaggccttcgtacggtgtagatcttcaaattaatgaacattaccactcttataggatctgatcaacttgaccatgaagtcggatccagattatacgttactggagcgcgcgctgagcaaccaccagcgtgaactgaccaagatcgatgatcggatatggatcgaggaacacaacgagatgctcatggacctgcagcaacgaattaagggtctccctgtagtatgcctacactttttgtttgctcgtgcaattcgagactgtgttcagacatcaacgaacttcaaactgattgtttctcgttgtatagaacttctcgctcgttgagcgtcatcgatatctgatccttgatggacctgtgcacaggatagcctctcgccagcctagtcgattctcgttcaggaggcacagcaatgctcatgggaaatcggaatccaaagacgggtctcaagagtggcaggagggattcagatcgtccgttccgcgacttcaagatgacagtgaggaaacacctaacattatcagcaaaccgaggcaattggagtattaccatcagcacgcgaaaccagctttcccattcagcccaccttcttcatcatcgtcctcgtcatctacgaccagtttgaagtcacccacgtctccgttcagtggcagaaaacccgtggctcctcgagccaagagttatgttgaaccatcacgccacgacaatctctctccaccaacctcttcgtcctcgctgtactcgctctcgccttattcggccagcgcccccagcgtcaagtctccgccgccgacttcaaagcagcccacggtttcacagctcgtttctcagtacaattttaacctttcgaccaacttcctgagcttttctggaaacggaatgaggaggggaagcgcaggacatcctagaaacatatcgtcctcagcactttacctcccgagtgttatcaaaaactcgaccgatgtcgaggccgagtaccatgtctttatctttacagacatcgtcctctggactaagcgagtcatgagtcggtaccaccgcaaggaaggtgtgccatggaactttaagctggtcgagcctgtctcgcggcttacgagtgtctgtaatactacggaaggtacgtcttggttgcctttaagtggcgtgcggaggcttcatgatcagaaaatcgtgagctgacacctctttgacatgttggactgcatagagaacatattcatgtgcacgtccgtcaataccagcagcatgagctacctggttcgaacagaggacgagattgcggccaggatgtggaggtcgactgtccctagccttgtcccgttccactgctcacgggaccagtccagtgcacggtagatggctcctttgctcatagcactacgcagtctgtgcgggtcgcgtagttgggacagtgggctctcgctggctggcacacgcccagtcattggccacagacgcgcgtggacagtaaaaaagctatcaaactttaaaacttttctacatattgtggccttctttcgctaccactctttcgctacagttgcactgcattcaacacattcgtccccttccatcactgacatcaacgtcctcatctgcaacactttgtcacatcaccatggctactgttcacaacaagtttctccgacaaaaatctgtcggtgtcatcggcgtccccttctctggcggacaggtgcgtcctcaactcggagctctgcagcctattattacaaaaaaaaattaagagctaaacgacttattacataaaatgatcttctctcctccagcccagagcaggtgtcgatcaaggaccgctcaagatcatcgagtttggtctgctggatcagctgcaggagcttggatggcaagtcaagtttgatggccatcgagactacacccttatgaagcccgcctccgaccctcccgtgggccgtctcttgaatgctcgctatgtctctgccgtcactgaatccgtcgcttcatccgtctcggcccatctcagagagggttcattggccttgacgttgggaggtgaccactccatagctttgggaaccgtcgccggcacgatggctgttcacccggatgcgtgtttgatctggatcgatgcccacgctgtaaatgatcacaaatcgcttctttactttttttttgttttttcccttcttgatgcaaacacttttactagctcgcctgctttttctaaacggctcctctttctcttactgcacatgcctttaggacatcaacactccagagtcgaccgacagtgggaacattcatggatgccccgtctctttcctgttaggaatcgctggtcaggttgaagtctttagctgggtgaaaccttgtctaaccccggatcgactcgtgtacattggactgcgggacgtggatgctggcgagaagaagatcttgcgtgaacatggcatcaaggccttctcgatgcatgaggttgacaagtacgggatcgctcaagtggttcagatggctatcgatcatgtctcgccgaatggctcccggcccatccacctaagctacgatgtcgacgcgatcgaccccgctgtggcgccctcaaccggaacccctgttcgtggtgggttgacattccgagagggccattacatctgtgaggccatccatgagactggttgtttggttgcgatggacttgatggaggttaatccttcgctggaggacgaaacggcggtctttcagacagtgaccatcggatgctccttggttcgctgtgccatgggcgagacgcttttgtaaaagggagtttttttgctgcagtagcattctggctgcggtcctattgatatagacgttcttagaagtagctccaacgaaaaaaaaaaatcacgtatatacaactgaaactgtccacacaagttcatctgcttacgcgatcccttgctatgtaaccaagagcatttaagaggccaacaggctgctcctgcaagcaccgtggttgtggaacagtaacaaatacgttcgcaaaggtgctcgcagcgagaagttcaattaccaactttgtgcgttatgcggcaagcatcaagaccccgcaaagcaagaaccaaagggaacatggtgcctttcagaggctagaggctagagactcctgccaagcaacttttctaaattgaacctgaaggagccggggggtgcacagagctcgaataggagatgatgaggagaatgagacgcagctatcgagcgggggggcgacaacagcccacagcgtactgaagatattacgtgcttttcggtcgttccactcttaatgttctcgtcgcaacgtgatgccagctcttaaggccactgcagggccaaggctttctctgagcgttattcaaatatatgtaacaattgctggcgtcttgcccccctcctttaagaacacgaaaaaaaaattgagttaaaaagggggtgtcggcttatgcctaatcattgatggcggtggtggagcatggcaatttcaaggcacgtcttggagacgtctacagcgctcacggaactctgccacaacaatattaacagaagaaaaaaaaagctcgtccaaggggacgatgcccggaagacggcacggatagacgagtaataggagagaggacgtgtactagagatgattcctcccctcgcaccaggcccgctcctgatcctgttacaccgggtgtttgggacttttttgtcgcaagagggcgagtttagccccgttgaagagattccattatcgcttgatctaagcgaactaaagcgagaggacgcgtctatcattgtcgccctgcaccatagaaaatcccgctccccgttccccatgatatcttagcgcttgattcagtgagtcccttaaaaacaaaggaccgatgtgcgctttcattttctttctacatagcgcaatgacctagcgactcctagcttcacacatgtaagcatcggtggctgcccctccacgaacgacctactgagcacgggccaggaggcgaggtagagccacgaattagttagggagagcaagattggttcagtgaactagcggtgacttcggacgtcccttacgttcatgtagcgtcgggctactgtacggtgtttcggaacggagagttgaactgcgtccggtcggggtccccctttcggtttttttttgcagttccttttctgcctgacgggtaccaatgcatccgtcgtcgtcgtcgttttgtagttgtgaagtataaatacctgggatcggccacttcaacgtcctaatccttcaactcacactcgcactcacactcacttccaagcctgcaccccacttgcacacacgattcatctccgatacacacacacgaacacacacaagtctatacaggcacataagcatacaagcatgaagatctctgttgcactgaccatcttggccgccctggtcctcatccaggctgctcctgtccacaagggcaaccccatggagtcaaagaccgacaacgttgccatcgcgtccaagcctgcaggaaaaactcttgccccagccggggattatgtcgcagtccctagcaagcaccgtttgccagctgcggtcgctcctttcaagcgtcgcggcctagccagctctgcaaagaaggctatcaagaagcgtcatgatgatgacgacgacgagggcgacgaggatgatgagggcaacgatgatgatgaggatgaggatgacgatgaggacgaggacgacaacgaggatgaggatgatgatgaggacgaggatggtgacgatggtgcggaggatgagagcagcaggcgtggtgccgtgatggagaagctaaaggctccatcgatgcagaaagcaaaggctcccttgatggagaaatcgaaggcgcccttggtgcagaaggtgaagggtcccgagctcaagaagcgtaagcatggaggaaagaagaacgatgaggatgagaatatcaccgatgaacaggaggacgatactaacaaggaagactcggatggagccagcgaccaaaacgatgagggtgaaaaccaggaggatgatggtgaaggccaggacgatggccagtatgaccaagacggcgaagatggcgctgaagaggagaaggttgctggcagtcagatttaatcgctaagatcttctctggcaagacctgcctggcagcactccacatccaatctactatatttatgtacatgtatccatcttttgtcattatccataaacccgtatgatgctacagaatttacatgagcgtgttaagaggcttatagctattgtcttcagcataacgggagggggttagcggacaaagctcatgttctcgaaaaaagtacagctcgatctcctctggcacattgtcgtcgtctgaaatgagggcgatgaccgccctgtttgatgtcaaatctaccttgagcactgcatactactggactactcttgtgataggctttctgttcctctgtctatacgagtaggtgtcgaggctgagaacctgccttgtttcaagatctttgtttcacgactaggcatactcgacgcataatccagtctttaccggaccaaacactcacttcaagtcagagagatcgtagcaaaacgtgttacaccctacaagtacacatgactctgttgacctcaagaacatgaaggtgtgcgccaagggcccagtcaaggtgggcatcgcaagactgacggaagtcacaatctgtggaatcagcacgcaatccaatgtcatcaaccgctgtctcaaaaccaagagccggtcgcacaacaacaatgcacagggtgtattgtcgcgcagtgtaccacacacttcacgcgccagttatgaacgcgctgtagccttggccaagtttgagacacgtctcgcagaaatttaaaaaaaaaaagaagagtccaaattttgaggtgagatcgccgggcgtgctgtcatgcaaaggatttctcaacccgatgtggttggtcgtcaaacaacaactaaaacttttttttcctccacgactgacaccttttgtggagagactcgaaccctctcagaagaaaaaataggccatggcccaccacttcatcgtgtcatgatatttatacctcgctctagagcaagtaccacgcttttatttctttcttccttttcgcctcttaccaagttctgttctgtctgcaaattccgccccatctcgcctcaccagtattatcataaactttgtatatcgtacaggccttcccgcttatccatactgccttcgaatcatgaagacaactgccatcctcgctgccatcgctgcagcagcctccacggcctccgcctacacatgtcccgatgagactggcgtcgcaagcgcctgccgagccagcgtcgtccgccctcgtaagtacctcttgcgcactgcactgacagacttgtgtcatgacgaatcctctcttattaaccgtgtaccactattgtggatcgcatagtgacctgcgacaaccccaagctttccattgtgccatgcaatgctaagcagtgcaaccagccctacgtcgataactatgccgcgtgtcagtgtcgccgtaaccggactgatttcttccaggtatgaatcacttctcttgctcgacaccaatcccctttgagtggtgacagcatctgctcataatgacgctgatactctttcgcacagaattctgtcaatgtcgcaggtttgctccggcgttgcaacgtgaagggcttggtcaacccctacggcgatcctagccagtataggcctggtcaaggcacccagaccttcactcctacgcgcactgctgcccccgttgtctcccccactgagactggcgtccccatctcgacccagagtcatcacatctctaagggtgccattgccggtatcgtccttggaatcttgggtgccaccgctcttgctgctctcctcggtatttgttggagaaagaagcgcaacgagcacaccactgtctacaatagccatgtcggttatgacaaccgcgggcccacacgcactgtcgtgaccgagaagattgagccagttgtcgtcaagtctgtccccgcaagtggtgcctcgacgaactacagcacgcccgtcacgggcgcctcgaccgttattcccggcaccacaggcaactacaacaccaccacgacccactctggcaacgtggtcggaacttcaactcaccccggtggagtgaatggtatccatcctgccggaaccacgactcataccaccggtgtcaatcatgtcaatcaagccggaaccacgaccaccacgtctggctacaacacgcagccccgtaccggtgttgtcgacagtgtgaccaatgctgcacacaacactgcggcgcactgaacaacgctactcactaagctcgaggccatcattgagcggcttctttcagtgtcggcgggtcgccacggggaccaaatctgatgctgggccttcacctgcgcgttttttctcttagctgtatatatgtgcaaaaaaaaatcaaacagcaaacatgggtgtctttccgacagccattgttctttaatccaccaagggttcgtctctaactgactagcctcataatcgtaataataaatataaaaaaaaaaaaaaatgagttatgtttggcgcgtgtgtgtgcagctcctgtgcagctcctgtgcaaagtgctctgcaacgcgtccaaagtccaggcattcgcaccgtgcatggcagtcactctgtccggatataatgggagctgtgccacactctgctttgtgtcttcgtcttttacatcgccttttgcccacatcccctccattctctgtttttcaccctgcaatcccatcactcctcctcccctcatttcttgtgaacaccaaagagcatgtccacccgcgatctctccatcaaaacaaacgtcctcaagaggtaacacttttcaaatgtcatggtttcttcttctctttggctccctgaggaatctcaattgctgaacaccttttgtcttcctgcatacgttgcagagtggccaaggagcgcgtcttctacaacgaggaaaaactcaagcaacaaaagcgtattgatgtcatggtagccaaggatcctgaagactatgaaatcaagaagcaggtacaaactaaacgtccccccctccctccctgtccccgtaacagccatatgccatcatcctttactcctcacaagtcgctgatcatcactccttttgttcgtcgacttagagagaggttctcgaggagacaatggatatgtttcctgatgtcgagaggaggctaaaggcggcccgtcaagacttggctaaccttgtggtatgtaaagccgccatcaagatcacgccttaatgcgcatccatctctgaaagagaaaatagctaaaattgttttgcattcttttgccatggaattgtatttagaccaacatcaacccggagctcaggtcatcaaaggaatacgaggaggctgttctgacgttggagacctacccgtaacggcccagggacggcgtacaccggttcgatctatcacatcctgccatagacccccccccctcttcaggattgagatattgcattacgacttctcatatattgagaaagctacacagtctatggagcgaacgtttgctggctactatgagtgccacagaagtgtattaaatgatattgggcgtcaagaatatgaaggacttggaggggtaacggacattcaacagagaataccattatgatccataatgtgcatcagctcctgcattggcacaatgtccttcttatccagtagatcgaattcgcgtccaaagctgacaaaatgcgcaaagagcgagttgaagtgtccttcttgacaaagcgatagcactttgtcatagtgcgaatggtatacatgagcaaagactcggatcagttgcttaaagatggcacgcacagtctgcggaaacgtcgctgggaagtctcgtcctaaaacatatatggtaaggagcaagagtatgagcacggcaggttcattcatagaccaccgacaggtttttttttctttgatagaaaggcgcatatggccttgagtggagctcgacgtaccttcctttgtagggaatgtgttttcgtcattgatgagtgtctggatccagctcatgacgaattcgatgtattgaggtgctggcactttgctcgcctttttctgtccatccatccataggtactcaaacctatagtaaacaagaggtttagtgtctttgtgtaggcactgcgcgatccaacaggtagctgcaacagtggatcgccttacccaactcctgcggacatgttggggcaatcttttactgtgcaaaagtcggagacggatccgtaaaacatgttgatgtagttgtaaaagtcaaagactagatccgacagtgatcaatcataagggttagagaaggcagtgggtatgcatgcttcgcgttggccgacaggttgtgatgtttaggagcacttgagcaggatactgtagacaaaaaatgagggcagggatggtttgttgaaaataagcaccatgcgtgagccgagcagagacgcccattctccttgtcgcgtctttcaaattgtacactgtgcaacatgaaacgcgcttctcaacacagtcagaaaaaaatctgagcaccaaatacggagaacgcttgcttgatcctgcaccccatctgcaatggatgactccggctgccagactccgtgagaaggacggagggttgattaaagagtaggatcagccgctttccgcccgcagttgcgagatgaagagaaagaacaaaaaaaaaagaagtaacagactagtgccgacgcaaccaggtcatgcaagcactgctgtgaagagaagtcgaggcggccatttgtagtagtggggcggatgcaggcgtacgctttgcgactatgactctgtacaaagtctcgtcgatctacctaccattgacggcgagccactcgttctcatcaacgtattttggaagttgaacgatggtcttgaagttgcccttgacgatagagttgttgcagtatggctggcacaggaagagcggccgaactgccgatgccgagcgctttgttttcggcttgacggtaaacctgccactaagaagagtcattgaatcgtcgctgggttggtgaggaggatgcgtttgggaggactgcagcttccgggtgcaagttgcacaggtggacgttctccaggtctgagtgagacaaaacgggttacagcttttacctgaaaaagctcatggtggtcgtggtggttgtgtgcaagacgaagagtcggtgcgcaatgagggcaggagaggaatgacgggaatggggtgatggggacgaggacgagaataaaggaaacaaggagacgaagaaggacgaaagaggggggtgtgtgcgcctaagaagcgcgcggtcgtgactgcatttttcggtagttgagttttatatgcgagtgctcagagtttgacacatctcgaacttctgttgtgctcatgatctttttttactgaccacctccagagaccagtgcgacgactgctccctcatgcgggcgacgggggcgatcatcccctcagccggggtggcgggcgagtggggtggcactgctgcaaatgggacgtgcaagcaaaaggcaagagaacacagacacagggattgcgtgcgagcaggcggcgaggggctccagtccctagagaaggcatgtggttgtgccgccgacgaccaaaacaagggctccatgaacagacagaggccatccccaggttaatcccgccgagcacactggctggctgagagacaaaaaaaagcgaagaaaaaaaatacacccccaaaaacaataacaagcagggcgcggattagtcaacgtcagcccgaggacagcgagagcaagacagacaacgaccaaaggacagccaggccgtgttcgtcgtctttttttgttttcttccttgggtctctctgttcgctccgtctgcccattcgttcgttcttctctctctccctcatcttctctctcctgctctctctctctctcctgctctccttctctccttctctccgtcacacatcctctccccatccctatcgacactcctgccatcacaccctttccatcccctatccccactgctcccactgctcttgtccaatctcactccccgctcttcgccctcgccactgcagcccttacatcacccagaaagtgggtgatcaaacgctcttgcacacctctcgttctgcattcggctgccgcggtcgatccttgctgcttccgttatctttcctgctcagcactcgtccgaacccaaccaacgctggtgagtgttaacgttttgaactcactgctcaaatctggcgcccttcacgccttctcagtgcactcttggatccctttcagtttactctgtagctaatgtggtttctatttcctctcgcttcattgtcgtcaaaatagggcgcctcttttcgcttattcggtctatggtcccctcgaatatctgcccggacatgcgtgcaacttcaccaactcttaaagtcttgccgacgcaggataccgctccgagcaaggatcaggacaaaggattgaaagcacaggaaccaaagcacaagcagctccaggacggaaatcatcctgcacactctgaagaatctagtctctcaaaatcggatcaaatcatgcctgccaacacgcccacgcctgcgcaaggagctatggaaggcgctgtgagcatctcggcaacttctcagaactcgccaccagccaatggctcgactgtggcacgcgagattagggacaccactccggttcatcatacgatgaatgggcatagcggcactgaaggagctcagccttcagcaagagccaccacgccaaaacatgtcaccgttgctggggatgtcggcgatggcaaggcacgccagcgttcaaaggaaccacctagcacaccatcaccgtccacatctgcttccggaaataggatcttatcagacgaaagttcacacgatgaggcacatgaggaagaggagactcaggacatcgatgttgacatggaccggaacagctatcaacatccctctgatgaaaagtacaagcgacttaagcgcaaactcaaggaggtgttggaggtaggattgtctctttcgctcgctattgtggggtctatacacagttttggtatgatcagacaagcgggtcgcttggtgctgactggtgcgttctacggaataatgataggaaaatgaacggatgagccaagagttggacaagtctcacagacgggttaggaatctgcgccgtgagaaaaagtatgcttccctcaattcgcgttatgcattagttaagaatgcctgctcgagtgagatactgatattgatggcaaacaccattatctcttccttttcacataccaaaattagcctgcttcttgatcggctgtgcacattggagcgacgcgattcggattcggacttagattctctctcgccgttgagcagtgacagcgaatcatccgactcttctgtcgtggacgaggttcaatacaaaaagacatcacagccaaggaaaaacggccgtggagctggcggtgctcaaagtactgcggcctcgcctggtggctccgcaggggtgaccgcttatcatcccaaaaagaatgcggccaagaacaaccgacgaccctccccagcagtgacatcaggagcagcgcgttcagggattaaggacactaaaatccaggtgccagtctcaacaccatccaccataacaaatgtcggttctgcgactcaaaagccgaagcgtgtacaccaaacaaataagcaacgaccgggtttggctaaagtcaggaaagttcaggcgctggaaaaggatgaggcaggcaacgtcaggcttccggtgacagttggcatcatcactatcttggatattggacacgttgtgtacgatcgtgaggcctttcacaatgaccgctacattttcccagttggatacaagatgtcgaggtcctacaacagtatgatcgaccctcacaacctgaccgtctacacttgcagtgttattgacgatggcgaagcgccaaaggtagactaaatgcgactgcctgcatcccttgaattatactcgcgatgactttgtacactaacagtgagtcgaaccctgtttcttcatttatgctctctatgtagttccaaattgacgctgccgatcagcctggaaaacctattattgctggaacagccacgggcgcttggactcatgttgtcaaggcagcgaatgccatccggcgacgtgatcactcaaactcggcatcaggccccgactactttggattctctaacgccaccattgcaaaaatgattcaggatctcccaaatgcggacaagtgtgaaacttatatcatgcagaggttcgaggagccttctgccgcaagtggcaccagtaacaagggctcatccgacaagaggaaagcatcagcgttgtcctcggccaaagcgggagaaaccgatggcgtcgaaggtgaagatcaggacgaagaggctgaagaggacgatgacgagtacacgactttgggcacaccgggcaagaaaccaaagacgtcatcgtcaccaaggattcgccatgcgggtatcgatggactaccgatcatcacttttgggagaccagtagaaactgcgttggggcttgacgaggttgagcacgatcggtcagacggcgacgaaactcagtctgaggcggagctcgtggagcgcaagatgtcattatccgcacccccaccagcactgccagcattcacatcgcctgcggtgcattcaattgccaccttaggcgagagccaagttccagttgtcatcacctccgtggaggacgcagaggcggtgaatgttgacgaccccgagtcggaagtggacgtaggcatggacgatgatgacactgtaatgcaaacaccgtcttccccggttgctgctccctctctccctgctgcagatgacaaaggctccacgatggactaggataagagccttggctcgaatagagaacctactcatccctatccactatccctatctatttttttcttcccatttttgcggtcgtcttctcgcattttagcgctgccaacattcacctacttagtcctttttatgcatgaaatataatcgtggtgtgcactagtatgtcacactcaacttgtaaactgatctctggcgatacgtttggttgtggtgcagggtgaccatattggcccaagcttggtggtggatggcgtccggatatcgcatcggctctagagatagacccgcaaacttgcccatctctgccacaatttgaaagcgactctttccagtggtgtgacgagcttcattgtgagctgggccctgcaacggcgtcgctgagggtgaaatcatcaagggcgacggtatatcgaggcccttggatttggtcggttgaagcagctcatgatccagatatccggccgcgtagagcactaaagccggctcagaggtcatcagatcgaggcgaatgcctgtttgtggcgaatacaaggttgctacatgaggagtacaggggaaataaccttgaattccaatgtcgcacactgatgaggacgaatgagaccaggcttttggagggctgagggcgtagacgtgatcgaatccatagccgccaggaagactctccagacctgggcccagacggttcaggcccaggtctgatcctggcatttgtgcagtaaagtccagccaccttgcttcctcgttgctagatgatgacacatctataatttggccagttggcacaggatgacgggcaccaagttcaattatttcacgagaactaagccaaagcgtgtggttcctgaccgaaaggcgattgggtagcgcgacaacctccttctcctcctcctcctcttgctgctgctgctgctgctcgtgctcacgatcgtcgagtacattatcctcgatcaatccttccaaaatgttctcggcggctttctcatcgccgctgtccgttggattcaagaccccatccaaattccagtatgtatgattggtcaaactgacaatagtgctgtgtaaatctagcacttcctgcactgttacgtcgtcgcctctcgttatatcccccctttcagcctccagctttgcccaatattcaatgctcagctctccaagatccgtgagccggtattggaccctggtcaccaatcggccagggtagccactctgtccatggggcgaaatcaattgcagggtgacggagggatcgtcttgctggacatccacagtcgtccaatgttgtttgtcaaatcctacaggccctccgtgatggcagtcgacgccgtttgaaattcccaatgtatgcctgggttcgtactgctggtaccgggcttgggcctggttctgggtctggatctgaggctttgctgcaccggaactgtggggtggacccgtgctctctgaaaccgactgtgcgtccttgtgccgttgaacgtcgtgcgccgaaccagggacgtacgtactctgaagggcgaatgctgcacggccaattctaccatcccagaaaacgagatggtgaaaagataaatgcaggaagtcaagtcagtgttggcgcacctatctgtctccagttggtgcttcatatttgtgataaagacagcacaaccatcccttaccgactagctgtgcgtcctatgatggctccaaagtaggggttcgcttcgcctggttctgcttgcgctatgtaagtttcccattggtcgaatccaagaacgacatcctggggttggttccagcggtctggataccggaggtgtgtcaatgtggcgccatacgtgagaaggatggcggagaaggtgcgggcccttgcagggctcttttggtctgcgctggcggggtcggttagcgtgacaaccagctcgtgctgctggaccagcacgggttctgtggcgagtgttgtggtcttgacgggcatggatgtcaatgaactcagcgggtgcgatgcgacgcgaatgtcattcggctcagcgggtgagatgcagcttgctttgtgcaaagaatttcggaatcgaatcagatggcaagattactctcagtcgcctatcagcccttggactcaggtgaccatcctgcctgcctgcgacaccgtttccgttcgcgtgtgcgatctcactaccaaattcagacctaaaaaaaaaaaaaaggcctgccatgattattctcaaacctgttcctgagtcctgcagccaatggaagacctcaactacggccaagctgttgctatcccatgtgagagagcggattgaactgaacatccactgctgcgaagccccgatagattgatgcatgcatgcaaaactggaacctgtggagtgttgagaccgcatggggagtctgtgcccattgcacatcaaaggcttaaatctcccaggcattctgccggaggaagaacggcaatacatggtcggagggtcgaaggcactcacccattgacgcctttcctgagttagacactagcagctcgtcaaagtttcgttagcgcgcggagaggtgttctcggacttgtccaagctgcttgaactctgtggcattgcacaaagggcagactgagagcaatgtaattttttgaaaaaggacctcgtgtcaaaaacaatcgagttttctgtgccgcttttgtgcgttgggtgaggcagttggacaaatacaacaatgtgttgcgtaaaggctacaacagttgtatcgccactgcgtcaatcctactatctgacaactggatgcgcactcatgaattcgtgcagaagcgcggcgaaatgaactggaggtaagagtcctgggtctcaagcggctgcagccagtccttgcctgtgcgaacgagcgcgataaacctaacctgtgcagaagggcgagagaagaaaagtgatcggaaactcaaagtactcattgtttgatagagtggagtcgttaacgaccattgttgaaggttcattctcctatcgcctatgcatgcgctgatacaataatgattaatatgtccgtactgaagctggctttatttagcgcctcgaaggtagattagaattctttgaattggtgtatgcacacacgcaggttgccaaaggactactgtatctatacatgaggtgcacatgaatttgcgctgcttctccactggagagcggaaggcaccgctctcagcttgccatcgccgctctgcttccccactccgcctcgctacagcatcatatccttcatgagtcctccgcgtatatacatggattacacgcagtatcgtgcagcacatgtacagtactgggtaaacctcttcccctcatacatgtacggtactggctttcatctcgtttctcttctctcctcttctcttacctctccccctccacccttccttcctctccatcctctcgtccctccatcacagcctcggtaactcttattcctccacacgcgctcacatcccctccacctaccctctctgccccgttcacacccagtcctcacgtctcctcgccgcacgagtgcttgtccgcacgacttccctttaacccccttccagcctcaccaggacatcggtgtatacccagacgcgacacctcgaccctcattcctcccttcattgctcatacgaatccaacaaccactttccacccctcgctgttccttcaacaacttcaagggcaaatgattcgtctcgttgccaaagtggccgtggtggcgaccttagtcctcggtctcctgggcaccacgactcaggctcaaggctcgtgtaagtctcctaaccctgaccagcttgagcacttctcactcgaacgatttcgatccgatcgaggctatattccgtgcgtttcatatcggcctttgtgagtggggggggcaccctgatttggtggcgtggattgttgcagcaggaacaatcgctcttgttgttctcgtccctggttctacgagcagtgtgcggtgtgtatgtgaatatgtcttgcttttgtaatatttgcagcatgtcgactgagccctgtggattgtttggccaagcgccagctcaatttcatatgaaggagagcaatagagggaaaaaaagttctctcgaccaacgaaattgatttccgttgcacagatgataagcagagagaacaaaaaaaaattgagctgtcaggaacctcaaattgagtaactgcgtcgtccctggctgtgcaggcaaataacaacacaagcgaggcagctttcgggaagtgctctcaacaagagtggatgtcatagtgaaagggtgaacacgcagcgaacaaccaccctacgtgaccgcggcccacatcgcatggtcgtgccagctaaggaatgatggccgcgtcctgtgcccctgcctatcctggtgcctgaatatttgatcggactcgcatgttaataatgccaaccttaatatggaaatagacgcacaatacaacggcacgctctgcaaggactatgtcaactacgacgtttggctaccacccaaccagacggtcgcctcaatcgaggccctgttggccaaggaaggcttgaccccatctgccgcgcagatgctgagcacgccctgcttcaagcccttcatgcagtacgcctgctcgtccgcctttcccagggttctgcccatcacaggacaaggtaagaaatctactctcgaacagtggagccaacagaagcaatctcacgaatcaaacccaaacacctaaccatgcccgtctgtctgatcaatagcaaacacatacaacgtccagttcgcttgcacctcggcctgccagaatgcctttactcaatgttcccagttcttgacagtgttcaagaaagcctcgcttgtgccaaagtgtgacgccccaatcccttatacaagcctcttcttaccgcccaacggtgtcaatttccaaccggatggtgcttgcaacgtcgtcagttcaatcagtggcctgggaccctctggattcgataatttgacagccgactgcaaccctccctttatcaatgatccgatgctgggacctaacggtggccccaccaacccactctactgcatgaatggatgctgtattccttgccctgctcaataccacctctaccgtgagggtgctctcgagacaggattcaggatcaccaacaccatgcgcgcagtatccatggttctcagcttcattctggtcttgacctacctcgtcttggatgacaagcggtcccatccaagcgccttgattctattcttttccatctgcgtgtttatgttctcggccgtggtcatcttccccttggtcaacaccaagggtatgcagtgcgcagatttgatcaaccccagtactcagcagaacaatctgaaatgcgccatccaaggtatagtggaataccccacctgtcaaaaagtgtttttacaggcgttgtcacgcaaagagagagagacagaaaaaatgctcacacgttcgattccaacaatgttaggtggtattttggtctttgcttcgatcgcaacctgtgcctggtgcacagctctgattttgaacttgcacttgcacactgtctggaactctgcctggttcgcgaaaaagtactggctcctgcacatcctctgctggggatttgctgcagccatcaccggtgtcgcgttgggcatgggcgagatcaaatgggaatacgctacactgtgcctggtctctcaacataaggcctcccagatctttttctaccccttggctgccatgatcttcccagccttcttggttcacattgccacgttctttcacattgccaggatctcggctatggccggtgtcgactcggagaccatgtcccgctccaccctctccgcgggcgctgccgcgatcatctctcatcgccgccacgtcatgatggcgatccggatccagtggcgagcggccttgatggccatctgcgccatggtctctgtcaccgtctactggctgttctactttatccaactcaagaaaatcaacccggccgagctgcagtacaacattcttcagtttgtgttctgtcttctggagggcagagcccatgacacctgcgccgatgagctggcgccgttcttgcctccttatgggctcatgatcgcggccgaatttgtcgtgtcgtccattgggacgattatctttattgtttttttcaagtttgcgcttgtgcgcgagtggggcgagaaactgtcttcgttgggatacttgctttcgggtcggaggaaacagaaggagcaggaccagttctttgtcatctaaggccctccccaccagcatttttgtcgtttttttcaatgtcaatagttcatcccatacagtaataaatacatcaccactagatcgttctacttttcctccccttttctctgttcttcagctgtagcgcacgatctctttcagaaatggagtagctgaattatgtaataatggcttttttggtatgttgtctgaaggtcatatggggtgtttcttctatgattacatgctcgccacggtgatcagtgaagagtcgcctgtaatacttgcaaaggccacctgcatcaggatcctgcacgcgatcccaaaaacaattaccagcgtcgtagggacatatccagtatctaagaaaactgccatgaaaaattaaaagaaaaaaaaacttagcattgattccgattggttgttggcctattcatccacgagagcaaggatgatgaaagaggatttatacctgacagggcctcgatgttggatgtaaagacgataaagttgacgaggtgccatgaatgctccagctcggcgtaatcccatataaccatcaagatcagcagcatcttgccaaaactcgagatgatcagcgttgtcgttaaatagttgtacctgatgaagcagttccgggcagaagacgcaaagggcattataagtttcttcacacacacggttttctgtggagcgggatgatgatgatgatgggacttttcgaggatccgaaccaacacttacttgagaattgcatatcggccgccataccacagactcacaatgagccgcactccaaaatgaaatgataggaattctaccaagaaggcgcaatatgcaacagacatgcattaagacgcggccggttaggttgcttcgtctttcacattggcactcgctttttaactctgcaccatagaggtcatgcttaatggctgagagggttttcatatcaagaaatacttcaaaaaaccggtttgttgaagaacaggtccgcacgtaccaatgatgcataagaagaggatgtatagatactgaaagatgagtgcgtgctgtgcaaatcccacttctccaaatgtcggtgtatgctccagtctgaaccacttgatgtagacatcaaacagaaccagcagtacgcccagcttgaatacgtttggctagaatccgcaccaaagagataaaaaatgtcaagacgttgcccttctcacattgacttatcccgcggaccaaaaaaaaaaaaaaaaaaaaaaaaaaaaaaaaacctacatcaattccaacatcccgatacggcaaccggttgaacagcagatgcctgtacactggtttcttgtgcaggatcatgtccacaaagataatgacaaaatcgtgctccacatacttgtccgctagctgcttgcaatgttcctaaaacaaaaatttatgagaaatagtcctcagcatcagcttgcgctccagagtggcctactcttctcagttgatttttttcctcaagcacgagatcgatctacaaaagcgttttctgctggatcttcagaggtaagggcgggttttgcacttacgcagtatgtaagtcgaatgttgcccttgctatattccgtgtaaagcgaggagaccgctgctccgcactcgacgcacgtcggcatatcggtactcgcgaatgctagctttagattcttagtcgagaccttccggtgcctggtggtacacagtgggtattgcttcggagaaaattggtaacgcggaggtggggacaaaagctgtggagagccgttcaccaaaaaataaagacgcgggagccgagtgagaacgcagcgttgttctagaggaaactcttttccaaaaaggatacttttgctgtgcctgtatgcaagtaggctagctgccctgcgcgtcaagatggagtgatgtggtgtagagtcttcagaatgtcaactggttgtcaactggatggaagtaaaaaaaagctgatcaggtcttttatttagcggtcacttcacatcctgggctaaatgaggctggccttccgcatcgccaaaatcgacgcgcccacaggcccatacccaaacgagcctgacccatggcctgttcctccgccagcagaggagccagcgacaaaattgaacgaagactgtgaagacgctgtcgataacaaatactcccggaacgaggaccggggcatgcgcaccgtaagttccctggtcaccttggtcagattcgagacattagtcatgacaagacgtgaaaagatttctggatgttgttgtggttgctgttgctgttgcggctgtgtgtggcgggagtggtgctggtagtgttgctgtgggtgaccatgctgctgggatggctgctgggcctgctgaccctggactagcttttcaggagaggccgtcagcgcgctaccagaagccgacgaagacgcagaaatggaaggtgtgatggttcgcttctggtcttgagacatatcggagtgtccatgcgtcatggaagacgcggctagatcggatccaggttgagaaatggacccagttctcatggctgaaggcgaggtggagagaactgccgctgacgatgttgaggtcatagttgtagtcgtactgctgctcaccaggagggccgacccggatcctgaccctgatcccgatccagagccattagctcgattggtgctggaggagagttgccgtaccaaagtcgagatgacgactacagacttgacaaaatcactcacgcccatgccgaaccgtcgtctaagaatgttggattcgtcagggccaaaccctgagttgacacctccatgatgttgcgtacttgaagactgctgcatttgatgcgggtggggtatatggttctgctgatagccgttgtgatggggcgcaaactgcgcgtgatggtactgctgctgatgctgctggtatagatgctgctgctgttggctttgctgatgaggatggaagtgtggaggatgatcgtctgtccggatcatagtcaagtccaggtccagtcgtttgacgatttccgtcatttgcaagagacagtctcgcaactcgtgccagagctgtgccgtcgaaggtgctgcgcctccgtttaagggaaacgggtacgacgacagcgctgctgaatgcagccctggcgtcatagattgctggccactgtactgatgtccagaattgggtcccacgagtccttgagagggcagagatgaggcggcgtacgaaacgctactgaagtttgacgaagatgtcgatgcagctccgtgctgataagtagtcgatggtagccccgagatgctgacagaccttgcggtcatgatgggctggtactgcggggccggtaccgatgacaatgaagttgcttcagatgctcgggaaccaactgtctgcgaatcggtctcacgccccaaatcctgtggaatggatggtagtgcaggatcaaacgaggtcctggaggatcctttcgtgtgcgacaccgctcttctctcttgctttaagccgtctgagccgccgtccttgccattctcagctatcccccctgccgccaatgcgcggtgggggacatccgttgctgaatccccctttgtggctgctgaggtggtagctgttgaggggaggacgatcggcaatgacacgcacatcccgctagagtagggtacagtatccgaggcagacgaaaagagtggtgttcggaccattccattctccagcttactaccaccacctccagagttgccactgtagcctataaggggttccgtcgagttcgatgctgacatgttgcctgcgacagtagcgccttctgtcgactgcagggggcttgtagttagggtgctgccaggagctcgatccttaaccaacgtcttgtcagtaacaatgccattggtttgcgcgctgctgctttcgctgctgccactgcttctgggaggagacgcggagacggatcgtgagcgatgaagcgacttctgttgcggactgctatcaagcattgaaaagctctccacacgcgtcacgcaggtctccgttagactctggatgaggcgccgtgcatactcaatggcccgctccactgtgatgaggagttgcacatcctcctcctcgtcttgattgtgcatggttgctgactgagagctgtggttgctggtccgagacatgttttggctccgatgtggaatctgagccggaagccacgtggcggaggagggcatagtaggcgagagctgaaaagggtgtggctgttggcttcctgtggccaggttggtagaggacccatgctgtgggtgctggtgctgatgctggtgcagatccttttgggtggactggccagcctcaacggcctccggattggtgtctccagtggtctggatgagcgggaggagtgagtcccacgccacccggatctcgaataaggctccgtgaagcatgagaacgagattccgcaccagtctcgcatcagctaccttgctgatgttccggatctgcatttgtaccatatggaccagcttcctgaaggcccccacgttcgattcgcagcaacgcacaatttcagcgcaaaggagctgatccgggacctgaacttgagcagaactgtcgaacttgtccaacgattgtatcaactgcgtcattgcactgttggcgctttgcaataagcgaacaaagggcaaactgaacttctcgtccgaagaacacccaacgacttgcttgactgccctgtagatttgtgacaaggcgaaaaggattccacgggcggcttcgaccagcttcaaacgctcattcggtagtggttgcgacagtggtgggtatgctgccaagcgttggaaatacacttcgctgaacttctcacaatcattcgatgtgttgcttccaaaagaactgttcgagtctcctgaaatccctctggaatgactgaaggcccggtagtgatcgtctcctcggctattcgatcgacggactaatgacgacggctccggcgagggctctgcaggatgatgtactgatcgatcggcgccgctaggtatgctgagtctcaagcccgattcacttctactttgacgatgcgacgtggccgtcgtcatactctccgatgcagacctcgctgccctagcttgaggtggtggcgttggcataaatgacggctcctgcgctgctcttgaactctcctcgcgcatcaactctctcgggcgaacctcgcggtctaatgtaaaagaggttgtcgcatatcagtttctggtacggctgggatgttatggcgcccaaatgagcagctgtgtacgtagcacaatgactcgatccttcaagcgcgactaatcaattcagacatctactgtcactcactctgatgtagtactagatatgctttgagacgactgagccaatcgcccatgtcatcccctgagaattctacaatctggggcggagggaagacaatcggattcatttcgatcttgagaaactgcaggttcatcatgtctccgacgtataacgggatagtatcaatgcggttcttggatatactcagcacctaatgtttgcacaaataaagagcgtaggcttgctcattaaacacaacgaactcccacaaacatgcagtggggaactagttacatcacagatactcaacggacccgaagattcatgaggcttccgaaatcatcaggaaaccgagatatcttgttgcggctcatgtccaagatttccaggctcgccaggtggcacagctacattgtggatggcggggaacagagggcattagattcatgactgctttcaggtctaaacgttgaacacgtcctctgccctcacgtctgaggccagttcttaccaccgctggaaaggtcttgatcgagttggctcggatgttgagatagcgcagactcgtaaacatgttgagctgcaggggcaatgttctgatagagttgtggctcatggtcaacctatgtgcataagaacaaagggaagaaagggggaggtaaatttcagcaagcgcttcggtcaatggcagggagctcaagaaagcggtgatcgccacagggtatgaagtaaaagacagtgcttctaatcccttcccccccccctccccacccccctttcccgcctcctccctccttctctgacgtaaaccagggcgcgggctgacagcctcgggcagaccttgcttgctcgatagtgttgcaacatagcgtttctggcataatctgctcaggagtgggggtggaagggagtagctgtgctgatccaatcctgctctctactctgctctttcctgctagtcgtcccagtcgtcctctttgtgctgctccttgcctcctgggagtgtcgcatatgatagaatgcccttgctctgaagataaaacattatttgtagacaacaatgctctctttaactcgaacagattcctggaaaactccttctaacaaagcgtccaagcccaactggtctctgttatatttaggttgatgaacaggctgcactgactgatgacatacttttcaaggacgtcccgcaagaactcaatttcggttgggaagacttccaggtgggcataagagagatccagaatctgggtgctcccagaggttccttgccgctggcgaataaggtccatcagactgctgctgccgccctcgtctgcgaagctgtgggcaccgtcagccgttcctgaagcggcctcctcgccgccgccatctccgccttgcgacatggctggcgagttttgatgggtaagaaaaatgaggaatgcgtgttgctattcagatgaagaggaagtgtgagccggagcgagacagagagtgaggaggtggtggagtgctggccaggctggcgtctttttttttttcttttgtcgtttcaaagaagggatgttgcaacggagtaacggcggaagcgtggagtggtgtgtgatggaatgagcatagcacagaacgaatgcctggatagacataagtgaataatttattttccacgtgacgttcacacttccaacgaagtgtcctcgttcttgctggacatgctgctgaacagctggaaacgctgcttctgcgccgcagccaggtcctcttccatcttcttggttgtagcacggatctccttcaagtatgcatcctcgtggtccatagcaatgaccaccaggtcggggaaattgagctggaacagccgctgcaccttgggcagatcttccttcttgggagcgtatgtgcccgagttgttgtcgatcagcagcgtccagtcgtcatgatggttctcgtctttgaacaaacggaactcgcccgagaacatgacctccgtggcgcggttggcgtgcattgcgtgcttggacatgaaatcctggaagaacgctgcacccgtctcggaaaagtacagacccttggggatgatgctgtacgtaaagacaacagtcttcaaatcctggtcaggcttggccttcaatcggtcgccgtggagaatcctgcccagatcaccagctgttgccatagagtcgtatactgtggtgcgtccgtggcggtagaggtacgcgtgctgtgagtggagggcgttgcggatgttcgtgccttcgagggtgtcagcaaagatgcgcttggcggcgtcatagttcacattccagtgctggtattccgcaggatccggtccaaagacgtcctgaagatggtataagcgcacacggtatgtgtagaattcgtacttggcctcgcgtgtcaaaacaccggcggcgtagctcgtgtggcgagagtagcgggcgggacctctggtggaaatcttcgtcagagctgccgatttgcccacacttctggtagcaactgtctattggtgatgatcaagaaaataacaaaaaggggtcgttttttttaagttttatgggctggagccaacaaacacgtcgtcatttctctgcgtgtcgtcctctgcaaatgaacaaaggtcatacctggacaaatacttggccgtgaactcgaccatcaggtctgatgaggtcaagggtatgctcgcgagttccctccaatgttggtccaagggtcaggctggccttgccaagaggggtgtcctccttcatcttgtccttgtccttgatgtgcaggtccaacacagtatcatcggcaacgttgagcagttcccacacagcatcccaaacaggattcagtgtattccagtgaatgccagtgctgcatcatcggacgaggaggaaaaagaaaagaaaggagtcagcaagtggcctagcttcttgttgttgccagtattggatgaacatgagcagatgacctacacgaaagccaaggtctgggggtcctctggggcacccacataggcctcaagaaacggatcggaggagaggatatcgccgcggggtacgtcctagcagcagaagcgcatgaacaggtacaacggtaagtttaggccagtgtgcacatgcaatcagccacagctgggcgccacctgcaaaagccatacctttgcgcctttgaaagtgatggtatagtcccagttcttgcttgggttggctttgtcgacggccccctgtacaagcgcagggtcgaccaccttgccgatggtgtctctatgacggttgaccaaggacgagaccttctcgtgaattgaagccagcatggtgtgcagtgaagaagggatgagaagaaggaatgagaggaagagaggaagagaggaggtgtgcgaacgtgtgaggcgaacgtgtgaggcgaatgaggaatggaaataaaagaagaaagaaaaaaggcgaggtaggaagggcaggcagaggaacgagaaagacgagggaaaacaaaggcgcttttaaggccgacgttggacacggaaggcggagcatcgtcttcccttcctcgtgctctcgtgcatgcgctcactcgctcgcccttccccttttggcgtgtccctggcgcgccacctcgtatgtaaccgtgcagcactgagacccaaaaagcgacgaatgtcgaaaggaaaaacgttgttgttccacccaccccctctcccgtcgtgctgctctcaacggccactccgattcacgcccaaagccgagcgcggatagtccttgagtaagcaaacccatccgccgagggatcacctcttctccccgctgctgcttttgtttgttcagagtcaatgctcgtgcgagtggtctagcgggagtgttcattctcgacactcgatgctgtcaaacgatgggtgttatttcatgctcctttccaagttacttggaaaggaaaccaagggacagctggacctgtccctgatttttatatgattttttttattttatttttatttgccggctgaaaaaacacctcatcccaaagagagcaggaggcgtggggcaagggtgtgcacaaggtagggcacagggaaatatagatgcagaaagatcttcataaaagtacagtggtgcccgggactaggctgcagctcatgatgccccatacagtgaattactatcgggtatgctgtcaatggagagacgtagagagatcgagaacatgaaagaaagagaggaggtgagactatgccatcttcttgtcaggttacctcatgctcactttttgtttaccttagccgctgcttgtttactctccagcccccatttgtcgccgcgagactctgcatctgggcttttgccgtggcctggtcaatgggcttcagcaactcgaagctgcacagcagctcctcactcacgctcatgaccgctccaaaattgtcgaattcgccacaataattgggtgcagaaaagacagtgaccagtgtgcgatcgttgaagaactcatacccatcctcgaccaccatgtgtgcgcggcacaccagatcaaaatcgtgcttgttcaagaacttttggataatgctccgaccaaagcagtatgaaactccgcgctcattgtcttcccaatccatggccgtatctgacgggtcagaccacagcaggtcgtttagcaatccataatccggcacgtccgtcggtcgtcgtagtgcccgaatgtcatccattgttccaagagatggcgagaggcccccatgcacgcaaaaaatcttgttggcgacaatgcctgctagtggcaggcagttgaacacatccacaaaagccttccacatcttcacactagctcggcgcttgcactcgtcgtagaacccgtaaactaaggagcaatgcgattcatacgggtgcattagagtcacttttgtccgtaaaggtatgtacgtgtatcatcactgagacagacactttgcctctttcaagaatgcaaatgtataccccctgatcatttttcaacgacgctagaaaaatggaagtttggcttaccttttgtgacatttgcgcactcgtgattgccccgaagcaagaaaaagttctcaggatatttgatcttgtagcaaaagagtaacaggatcgtctccagactctgtttgccgcgatctacatagtcgcccagaaagaggaaattggctgacggcggaaacccgcacatctcgaacagccttagcaagtctgtgtattgtccgtgaatatcacccacaatcttgaccggcgcattgagctcaatgagcgtcggctgcgatagaaagacctctctggcggcctggcaaatgtagacaatctcgttgtttcgcaagcaaatgttcttggcgaccttgccagagtagcctgcatcaagcaacctcgaaatcatgtcatcaagatccatgcctttgctgcccttgtccatagccgatcccaagaagggcagtcgagctgtcggtgatagttctagagacttgttctgagagttcgactttggcgacagcggaggcggtgatcgggaggacgtcattccagtggcgggaatggatagaggagtaaggctcggcctcttgacaaggatgggctgacctggctccaggacagcgaaaggaatgctgggctctggtggaggaggcggcgttgactctcccattggctggtttggtatctcctcgaacgagtgctccgttagggtgtctttgctgctgttgtcgtcacggctcttttcctgcgagtgtccttgctggtggtcatcgtgtccattgggaagagtgccatggctatcatcgttgctattctcagggctgttgctgctgctgccgccgccgagaatgttgtttttgatgtggtcataatgcccctgcatcatctttgcgttcgagtccttggggtcggatccttcagacgacatatgtccatgattatggtttgccccttgcgtgtggccagctaaacctgagctcggatctggcgtcgcctgaccaagcaaggacctctgagactgctgctgttgttgccgctgttggctcggcggatgattttggtagtaatggtgcgcactgtcgtttgtatgagccaacggtgggggctggatcatgtcacatcctattagggacgacttcagtcgctgttcagacgagtcctgactatgactcgagacgatggtgccagaagcgacggaggcgtcaatcttgacggggcttccttcccccgaaacagcggtcgtgcgcgggttggccaacaacgacgcagggctcgggtgggcgctggcgctgttgggcgctcccctcgcagactcttgagaaggccgctggttgcaggacttgtcggcacattgcccaccgccattcaggtcactgtcgactttttttgcactttggtcttggagagtagcgtccgtggtgtagtcgtgagcgttgtttggcttgtagttggcgagaggaccggctgcactagtgccctctggcagggttcgagtggagccttttggactaggccgcttgctcagctggttccccataggctggtctgttcacggctcggagggtatcaaaagcaaaagcgaattaaagtgcagccgaaaaggatatatggagcgtgaggaagggcgacagagagcacacaaggacggtgggtcacttgatggagttggctcgagagaatggagagacggaagaggaatggaatcggtgcccacggcgaatggcaatgacgccgatagctcgtatgagggatagactggtggaaggacaagaggaagaggagcagggagagtgcgagagggagggtgcgagagggagggggtgaaaagaagaaacacgacaaaagaaaaggtggagaaggagcgaaacagcagaggatgggagcgtgcgccttgggtctttttatttgttttcaccttcctcgccgccatgtcacacccccctctttcgcctctgctcgcactccctgttttcttttcattctcgctgtcaacaaacacaaagcaggtgcccgcccgcaagggctgtcgctgagagcaacgatcgcgcacacatgaaaacccgtcaggagaaggtggccctggcgcccaccacgaatagaatcgtaaatcagaacgaagcacggaggtgtacccaaaagcggcatcggcgagatacatacgtgtccgtgtccagggaacatgcttgggcgaccacgacgctttcgtggcaccaacgcacctgtatgtatcatagacatccttcaacatcgttcgcgtctgcatcctgcgtatgtctcgctagccttcatgtgtccacatcagctacactcaaacgctcatcgtatgatgccaaaaagatcatcgcattactggcaacaaaacatgccaaacgtgtagggtcgtcttgaatgtcttgcgcgtgcgcactgcgtgtgcacgcgagtgtgagagcatgtattccaggggggtaaacctggtcagctccacgtcccatctggcttgtttctcggtgagactgcatgtggggtgcatggcaaacagctctctgggtgctcttgttacaagcggacggatgtcccttgattttgttttgctctctcctcgcctcgcctcgcctcgcctcagcatctcctcgttttactcccctcctctgtactctgatgagagaaaagaacaaaaaaaaaaaaaaacgtcgtatctcgagtactgggacacgacgtttttttttttttttgtgcgccatagtctttacgtctgaactgtcatcatgatcgacgttacgaccttctgcgtaggtggttcatggcatcatgtagattcgttgtcctcctgcggttctccgctagttttcgttcttgacgccagccaatcaactgtaaggaggacttcttagatattccatcatactggcccctccctccatccttggtgctgcctgttgaaacatcaagtggtccgagtgtaacggtctctacacgtgactttctgttttttctttgggtgagggcgcgttcacgtaaacattgctctcgtcaattacactcaaaaaaggcatcggtcatgtccactgccgcgccatcaccacaactcttgcagcgggtcgcagagaaaaagcaggaactggagcatttactcgtactccgacaactggccaatcatctcgagacccactttgacggtctctctgagaagtttgatggattgacacaaggcaatcaaggtacaggacatcacacacgcatacatacacatacagacacacaggattttcggggatggacttggctgcctggtcgtgagcagcagcgattgacaagacattgaagacggagattgactcttttcgacctttatgggtctttttttttcattgttttcactcagccgtgtccaaagtcctcggcaactgggctgatgtggttcggaccatagacttgacaggtacagggagtttttttttattcggttctacaaataagcagaagactgtgaccaaaagtcacgaactatccaatctaatatgtgccagcatgttttttttctcttttgttgtggcggtatcgacatagaaaattacgcttctcaggaactggaagaggatcaggagcggtcatcccttgtcaggatcccaacggcttgaagagagctcatctgcttattagaatgccaacaagatatacccaggtcctgcatggggacaaacgcaatgaacgaaaaccacatgaagacaagcgtaccacttttttttttgaaggatatgtttttattcgtttcctgttgtactagagtaaagatgcattatgagtgaaagggacacgttcggtagcaaaactgaaatcaagtgtgttttttttgggtctttttgagttgctagcacttgaagcctactgctgaaagattcttgttttttcttgttttacaatgcctgggcatcatactcggccttctcaatcttgtatgcttccatggcgattctgttcctctccgtgtacttggccttctcggcctcgtcgagagtaccccatgcttcggcgaaagccttggactgctccttcagtgacaaatgggcgtacttgccggtctcgcggaggtgcttggcatacaggaaaaagttggacagaggcctcttgggtgcgttggggtccttgagtgctggaagtcccttcttaccggccttgcgcaaagcatcgcgacgctggttctcgaccttgtactctgcaggcgtcaactcctgtaggcggtccttggtctcctgcttgaatgcctcaaagttggccttgtatttatcttggtaaacctacaagttgttggtgttgttttgcccaaggcacatgaagcggtcagcataaacagaatcgaaccaaacgagccatgtttaatacagtaggaattctcctcggagaacatacctgcttctcttctgggctgaggttcttccagagttcggcagcgacagctccttcgacagtgggaacgacaggctttcctgaggccttgaccttgtccatgtgctccctgaagaacatgttccaggaggtgccgggacgcttaggcatagggatggcctggactataaacatcggaaatagatcacacgagtttcgtcttggttagcgagctgtgctgttcaacgcgacgggtgcctgagtttcctggaggacgtattttaaacaaaaaaaaaatctcgacgcgtctcgaaacgagcttccagtccaaggggtgaggcgacaaggacgcgctaccaccgttggtgagagaatagacgactagctgctagagctattgctttatcatcatctggtacttgggaaatcaaaagaaaagaacagaacagaagcgagaaaagaaacaaaaaaagaaaggaaatatagcacttcacacgacgcgacattatcataacaaagaagtcgaaagccaaaaaaaaaggcgcaaaaaaaaaccaaaaacgagaaaaaaaaagactggggtctgccttcacaagctgtgtatgagcttatggatgcaaagacgctgtccaacacacgtctaaaacaacaaagaaaaaaacctggcaccaggtgttgtggaaaaagacacccgattcggatcaggcacaggagaggggaagaagcgcgaccaatcaagaccgcgacaagaggaggggagcgggagtgtgcatcggagaggatgggcaggctgatgaggcgggatgacgggcccgtggatgagggtggggaggggtgggggatggaggagcagccgacgcgacggcgagaaggtcgtgtgttgttatttagggcttactctttttcggctttgccaccttctccttcttttccttgacttccttgggcatagtggagcgtgtgggtgggcgggcgtgcggagggcgtgtaaaaaatgatatgcgtgctattagcgggtgggcagtagctggcgtgggtgtatgtgaagagagaaaggaaaaaagggaatagtgcgctggggtgggccctatattgttgaatctcgcccgtccagaaaatttttctcctgccctttcagtgctcgccctgctgtcacactgctactctggactgggaggggcttgaaaaggctcagatcagcccgaccaataggagacagagccccccttctctcgctcatagctgagatacacacatacccaggccaatgttcatctatcttgcttgcaacagatgcacccagctggatggacaaggcttctatgctgctgagatacacagcacactttcatagcaaggcaatcttgcaaaagctgcaacaacaaaaaggcttcattttatagtgcagagggcaaggtcctgactcttctggacgtatccttgggcacacgttacctcttacattgctttgtttcacctacataggcccgttgcaaaaaagcaaaagggcatcacagttgactggccaagtcatcataggacaaggacaacttcagtagaaaactatagaggaaatggggaactggcgaatgctcggaaatatgacaggcctgggggggcaagtgcataaagtggcgagtgagatgaaaccctattcaaaacgcaaacccttacaacagttgccgcacactgagtttttttagcagtaagagagacggagagagagagagagagcgagagttgtcgttgggttggacgggcgagctgtacttggggattgtgcatagactgctgccttcatcaaactatgtatccagctgtgcagctgtgcagctgtacaatctgatgggatgaggcggcttcgtctattcgcgtaggtgatagccataaagcgcgttcccaaccgtgaccgtatgcgacactcgcgttgacacacaaccacaccgtacggatgctaagattcaattccgtgcttgttttcaactagattcgatttttcaccagattgaacagataaagagtctgggtacgccttcgttttatagggcgcattcttgagctcgaaactagatgatgtaactcgcaacagttcgtcgatggtagcgggatcgatccctcaaatgtgacccataccacaggaaccaaaaaagaaaacgtgacttcaaaccttattcgcgacatgaacggtgaacgactgcgagagctatggttttcaacgttcgttcagacgtcagaaagaaccaggcaagtcctttgacttgagaaccgtaaagctccattaactcgctgccgcacaagccgtgcggcaagagtacgtgcgacccataataacaaaaaaaagtcaatacagccggttttagccacagatagacacctcttatgattcgactcggaaaagtactgatcctctaacaaactccggacaagactttctacacaaagctgtttgatgaatctgatgacaccattgagctgaggcccatggtctctagactaatgccggagaatccttttccaagacccatgaaaacaatagaagcaagaaatccccgcgcgtccttgcttcccttgttgccactgaaccggttcaagttggctcgccgtagaactcaaaactcgtatgttcgtgagatgggctcaaagttgtgcaatcgggcagcgcatgggtcaaccccattgttcatgcatcgaagagacgggctccttcccgttttacactatcgagcggcgtgatattccaactgccgcaggttccctaactcacacccttgcgtgaagttcaattaaaacatcatgttgctgggctgtgcagaaaaaaaagtatgacacccgcaacccatttgaaccacgcctccacagcaataacgtagactatctaaatatgctctcggtagtcgcgccgcctttcaaaaatgtcctcatccttggaactcagttcaaacgcggcatggtcgagtccgcatgcatttgtggttcagtgtaacgcgcggcacctgcaggttcaggatcgatgccgcggaaacgttgatgtggaagccatcgacccatccggtataaaaagcggccgcctttacctgtgcaaagagtccctcaatcacttctcaactacacacacacactcacacacactcactcacacatacacacacacatacacgcacctccccaaaccaaggcatggttttctttaacgcgaaatcaatctccagcctcgtcgtcggaggggtactgatgatccaagcagctctgacgggcgtcgagggtcaagcctggagggcccatcacggcttgacgggcgcggccttccaaacccagttcgacaactatgtcagccagggctaccgcctgacgcacctcgacggctacggtctcaacaacgtcgcctactttgccgccatcttcgaacaaacctcgggtcccgattgggttgccaagttcggtttgacctcggccagttaccaagagcagttcgacagcctcgtccaggacggctaccgcctcaagaaggtcaacggctactctgtgaacgggaacgagcgatttgccgccatctgggacaagtcctcgggcgcggcctgggtggcccgacacaacctggactcggcccagtaccaggcggcctttaacacgtacgtctcgcaaggataccgcttgaagcacgtcagcggatacgctgtcggctccacggccaagtacgcagctgttttcgacaagagcgcaggccccaactgggcggcccgtcatggtctgacctcggcccagtaccaggccgaggttaccaagctgaagggagagggttacagacccgtgtcgctcgacgcctacaccgtgaacggtcaggacctgtttgcggcggtctgggaacagaccactggacctgactgggccgctcgccataacttgacgtcggctcagttccaggctgaatttgataggctggtcaagttgggcttcaagttgattagcgtgtctggctatggcactggatcagccctctatgccggactctggaccaagtagaagaaaaattagctcaaaacttccttttccccttgtagagcaaacacttttccatgagtgggcatcaacacaatccaataaacatattctggacccacttcttctgaattctgtgaacattcctgtacatttttttgaatcaaggtattaaattacttctacactagggtgctagatgagatgacgaggacaaagtaggtcaagaggatgttgtctctggcttttcagggcttaatggtcctggttctgtggaaggtgttgtctgggctgggtgtggggatgtcttgtcattgcctgctctcgtagctgcggtctccagagagccctctcgattggttgctagtacatccaatggatcctgctcatgttcctgaatcgttggagtataggacctgctctgcaaagaggtcctagatgactgtcgactcaatgggctcatctgatgcagcgaagtggtggattccgaaaagggaaggacggaaggcgagtgcaaaggcgtctgtgccagcggacgacccagggagccgctcttggaaggtctcagcaacaaagcggtcgaagagactggagacgatctcgccggtcctgaaaaggtcctcgtcaatgtgcctggccgaggctgaagcgacgatcgtcccgttgtggatgcggttctttttgctacacgcgggctgttcaaaatcaagttctgctcctcgacatgctcagcgtcttgctgttcaggtacgggctccagggtgtctgagcggtagagcgactgtgaatccacgagcgactcctcatattcgcgcttttggtgcaaagccaaaatcgtcgctgacactctgccagagaaggttgagcaggactcgccatcgctaatcacatccgaatcgtcgtcgtcgtcgtgatctgaaaacatgcgatccagaatctcatgcatccgccctgcgctcgctgcaacgttgctgctatggtgactctcggtaggactctcgggtcgcgaaccatcacgacttctgatcgacggcgttctcttgctaccgttggtggccacatcaggcttgcctgcctcaaaaagtggccctcgcgtcgtcggcagtagcagcagtggtggtgctgtcgcgatggacacaggaggaggtctcttgtccgcatctgagggcgactccacatactgtcccgactccttgcgccagtattgcaccgccttctccggccccttggaaaccttgagaatgccgccgccttgcagaatcaagggcgaatcagtcatcagcgcctcggcaatactgctctcgaccgagttgcgaggatactgtggtccacttaaaaccgaaactctcctgctttcgggcgtctcctgttccgacaatgactctacgccgttcgcgaagctttggcccaccttgggtctctgcgagagcgtgtacacggacgtggcttcggaggcggtcctgtttagcctggcaggcgctggaggcattccggatatcgaagactgcagactcccagcttgcgatgccatcgcctctggattggcgacgaataagctcctgttgcgctcattgttgagtcccgattcctgaaagaagcgactgatcccgatcgagttcagttctctcagctcatcgccgccgtcacgtgaaattcggccgtctcttgaagagtccatgcggacagggggtggtcgcggtggtcgcatcacctcaaaagcctttggtttcgagccatcgccatgggatctcctgactgacgtgcgcccaatcttgccaaaaagcccgctcagggatcccttcatggacgcccaaggactctgcttttcttcgtgatctcccgcggacgtgggagacgatggcgcgtggctgtccggtacatacgcgtagcgaccgtctctgaagatttccgacatcctcctactccggaggtcgggtgtgccttgctggtgcgacatgcgttgaatacgtgcatatgattctcgttgcggctgaaatcgtgcagaggaaagttgcgttggctgaagagcaatatggggtccatccatcgactcgatggatgctccgggcgagtgaggatgaggtgaagtcgaacgagcagacatcggacccgcagagctggataaggggatgatggcttctggacgcatatccagggtaaggacaggctcatcgtccgagggaaacctggaccgccgtcgatctggcggctggtgtgaatggcgatagacaggcggtcgatgttggtaggtctccgagtcaggcacagagagtaaatcgcccacggacgtgtaaggctgaacggtatatcgcctggtctttgctgcatgcgacatcctggactctggttgatggctgagtggtctagcggtcaaggtccagtcgtgctcgggttgtaatgggccctcgaaagtgtaagtcttggtcggtcccctccatgtggaagaatgtcgtgtttgccaaaacaacacaacttggatcgtgttccagagcacgagtgcgaacatgacaatgaacacggccagatgtaacgccatctgaatatatccaaagagctgacgtacttctggcgacgtgtcgagatcatgcacgtaggcaatcgagcatcctgtaacaacaatcctgacgaatccaagaaacaaatggattttgttgtctccagactctgcaaagggccacttgagtccaatgaccaacatgtatccgagctcgactaccatcagcaccgcaacctgagcaataccataagacgagagcatcgcgacagacaggccccagagaaagcggaccaggagtgtgacaaggaagaataacgttccctcctccgtgagagtgttgtagagtgtcccgtacttgagtaacgtcccaagatccccgaacagttgtagctcggaggaggcgcggagaatcctccaggtcaggaaaactgttgcgccgaccgagagtataagcagtgaagcggatgctattgccatcatcgcggtgcctcctgagattgtgagctggtacatggccgagagagccagtggggtgtagagcaaggcccagacgcgaagtagattgcctgctacaaaattggacgcgtgctgtagggtcttacccctgagatgactttccttggcgaggaaccacgccatcactagtaaacctcctgagacaaagagtgatgcacctccgaccatgatagtgttaataaaagtgcagaggaataacttggaggggtatgctccgattgcggccgcgtatgcttccatgccgaaacgagagacgttgtactgtctcgattggccaaaaggatccttgaagattggaacgacatagactgacgacggggatgctgtgggcgaggctgtcgctgttgctgtcggtacatcggattgagacgtggcagctgcagatctcgatttggacttgctggatgagctggaagtggtcgtagaagacgcttcctctgtactagacgtggtcgttgtctcgacaggagtaggggtaggttctggcggctgggatggcgatatagcgttggtcgtcatgtcaagctggcgctttctagcaacgacggaatgagaggagaggagcgatgaggtgtaagtgaccatgtacgttgccctgaccccggcgaagcagtccagatacatatgcctcctcttcagcctttggtgtcggaaaaaacggatgcaggcacccctacacctacgacgcactaagaccttacctatacatagtggctaccggattcgctggctgtgtaacacttgtaaaaggcgattcccggctggttgtccaggacgaactcaagtcatcctgggtccagccagctgccaatagccgcttgtccagattacttccgctccactttgacggcgcctccttgatctggttgacagaccctgcaccaccataggtgagcacatcggttgagttatcggggccgtttcctgcaaaagagctgcggaactccaggaaggaccagtggaagagcgcggtgaatgtcgaataaaaggacggatagttgacagagagctggcccgtcatcaccatgaactgcgtgtaaaagatgatgtcgaagagtcctggcgtatgcacactgattaaatccgatgtcgacgtcaatccatatgtcgccaaggcacccaagaatccgttgccgacggttgccctgagcagtatggacgtcaagcttatagcgccagaatagaccgcaagagcgagcggtagatagcccactgcggtgttgactgtttccatcctttgctccaacaagatggcgacacaggcgactgtttggttgttgccgcccataatttgaacactgatcatgagctctgcaaacggcgctgtttgagcgattgtaaagttctactcggggcatgggatagtcgcatgttagagtcgtttgtcaacagggtgcgagaacaaaaagaggccttatgcccattctacgaggcacttactgtggatatagaagctggtcccggtgctgtgggacagcctcctgctatcatactgcaggcgggaccttcgctcctgtgcagctgcgatcccacgatggtggttacaatcgacgaccgccctaagaacaccggaagtatggtcagtcactggtctccatcgacatggctggatagaaagtaccgcatggacaaggcaacagcgcgcttcacagcggcacgcgcgttggacagtgagaggttgagtggagtgcgcatgtgccgacaggcccacgctccgtcatcctgcccgttcaagtgccgtcgagaacgaagggaaaaattattattgcactgagtttcccattaaccttctttgtccgtttgctcataatacaaagacaagtatatgctgagggagcagggggcgaggggaggcagaaaccatgcgtggaggggtgggcaggggggctcatccgggcagattttttccaggcagagagtacaacgtcccgcgaggtctggtctatgtcctccagcctcacaggttggatggacaggtaccgcgctgtgtctgtgggtctgtgtgtgtctgtgtgtctgtgtgtctgtggggcgaggcgattttcttacattggcttgtggagagcgcagtatacgtctgaggactctggcccgtgaaattgccctgcaggtccagcacgacgaccttgttggacgggtcaaagtgggcgctgacagtacccagctccaggaccgaccctggccctgagcagtcgacgtacggccaggcggtggtggcagaggggagaaggactatacccaggaacaagagcagcagggtctgctgccatcctcgaccttgtcctgggaactccatctgtctctgcgtccgactctgcacaatgaaaaagggtcggacgatgaaaaggagggccgaggcactgcttgatcaacaatgatctcagggaatgcaagggccagtgagcaatgctgagggaacgagtgaatgagagtgagagagcgagagagtgagagagaaagcgaaggggagaaggagagaagaagggcgaagagagggtgcttttcctttttcttttttttcttgctagacccgaagacgagagatggggagcagggtactagacgagggcgaggatgcacatgcacatgaggctgtttcccggcgagcggggtctgtggggggtcgtggagtgttcctgcagccagcagcagcagcaggcgtcgaatgtcgaggtgtgctggatggagggcggaagaacaaggataaaagggacaaaagggacaaggcgtgcacgagggggtggaggatgaggaatgcaatgaggcagaacggatgaggaacgagcgacagacgactgcttcagagttcatactgcgcgctatgtattccgctggagagcacagccagaggtctcgccagaaagtcaagccaaggacacactagcagggatacaaagccgcgatcgatcacagggagcgaacactcagggacagaggcccaagaacagcactcggaaacagcaaccaggagctgccatcgggaaccagatgcaaagcccgtggcttcggaccgatgccagcgcgtgaaggcggctccagtattgaactgctgcttggaccgggtagctgtacgtgagcgggagacttgcggccgaatggccagaccaccgaagcgaaggcgcgtctctgcaaaccagatgttgctcaagtgaacgacgagggtgatgagtacatgtagagcagatgaagaggatatgatgttgggggtgggccagccatatatcctcaacgagtgtcctttgtgaacacccatacacgatgtcagcccttgatctagacctatcatgatatttgagagcacaatcggcacatcaacaaagacctgctggcacatgcgtattcaatccaaccgtatctccagctatcgcctgccttgtcccctaggcaagaagggcataactcacagggacatggaccccctttgcctgcacgctcgtttttgttgaactgctccatagggcacacatccacacctggcaagcgtactttgttcactggaactgcacagtcagcgctactcgccctcctgggaaaatattcgagacacgccgatgagctctagtcagtctaacccacttgggtcccccacactcttcgcagttcgccgaaactacaccctgccacagacaacaccttggctgaaggatcgcgcgcctcgcaacggagaaaagagtggagacccactaaaaagcgactacatacacgcgtgacctagatgtcgatgtaagcaaatgctaacttttttgagttctctatgcgaatggacgctgtaactatacagaatggacgctgtaactatacacaagcaccgctcctcactatcccgagaccacatcatggccagtggccagctgtacaaagtcgtatgcaatggtggtgcagatcgctgctgccagcaggacgagtgccccccatgcaacctgaagactcgagaatgggacccacgccggtatcgcccgaggactccacctcgcgtcaaacgctggcccgtctgtggcgccgtattgcggcaactgttgactggactcgaacaactgccgctcccctcgctccagctcaactgcatccaaccctggttgctcctcttgaatagacgattcccgcagatgctcccgaacaggtcgcttgccaatctctgtcatcgaaggatgaggcgagggtgggagagacccaacaaaggagggtgtgcgaccaaaactggccatggtcgatcgactaggatctcgagagtggccacgcagactgaaccaagaggatccaaatccttgtgccgactgcggctgatcttgagaatgagatccaggactagacggctgatgcccgtagctggagtgcggacgactggagctgaaaccaggaatagagtagttatttcctccctggaacggcgctgccaagaccttactgccaccgtagcgactgctgcgatggccgaggctggctcgattaatagcggacactgcccgttgtggcgacggtggattcgaagacgctaatggacccactgtatcccttgcctccgtgggccttggtgaagaagggtccatcttgggcctctgcgtcagcgatggtgacggaggcatgaggtggtttgcagggtcgaatgccaccaaatgttgggccttctccttcaatgactgtgtcgattgcactctggccgtgaagcgcctggatcgggaggagctttcctgcagatctgcaaaggcagatacggtcctgctatggttgcggccagtaagcgactgtcctggctggaacgagggaggcacagaaggtgatagggagaaagattggcttggaacttcatacttgtcggccttctcgtcctctccactggctactccactctgagagaggcatggctccgtgacagaaaatgagagcgatggaacactatgcgtgaggctccccttctcatcccttctcccagatgctttcaatgtgcctgagctcgacgcctgctcggtagtggtcttgatggcaaaagatcctggctgtgacacaaacgcggccgccatacggcctagtgagtcccgtcgctcctgattcatgtgccccaatctatcggcaagtgtcccttgatcattctcagtccgcgcaagtgtgagttctggaccaatcgcaccatagtcgtcgtcatccgcgtctcgcgggtcaacaggttcacagccgttgtcatcttccgggtccagaagaatagcccttaatccatgcgcatccgaccccgcatcacgagttttgtagtttgcgctggaaccggacgccagccgactggggcttacaccccgtagacttgccactgctgccttcatggctcgctttgtttcatcaccaaacgagggcttgcgctccagctcgggcggtgaaagcgtcaatcgtggctcctctgagaacgagactcggcgctccaaggaatatatgctttctgctgaatctggggtggagggtgggtggtgaggttgcgccgtggatgtaccaatgggcggtcccttagatcctggtccgagtcgggtcgcatccgtcacgattctttccggcttcagagagtctctcgaggactccatagggcgaaaaattgagggcgcagatttcgtctcggcatcgccgccaagtcctggcggtgtagccaaggcgaaagaagcctttaaaggaccaagggggaatgacgactccagagtggtctcggttcctgtatagaaaggacttccaggtctcggatcatcaggacgtcgcaactccagcgttggtggtacactcgttcctgaaggtgaagatgatggcgacaaggtgagggtggacgtggtttgtttgtgcgccggaatgatcgagctcttcctgttgagtttcttgacagctgtcgcttggctggctatctctgagggtttcgtgacaacaagatcctcctttagatccttctcgctcatcttttcgcacactgatgacatactctcccgcgaatgtgtcccgaactgcgacggctcgtcatcaaaatcttcgtcgtccacctctggagccgtgctttgactgaggagaatcatgggcggcacgggcttttcattttgttcctcctcaatcgtcatggcttgctgttctattgctcgcttatgtctctccgagatcatggacaagatcttgtccttgtgagaaacccttctaggcagcgctgatttcctctgagccatctccgttactggatcgtgcaaaataacggtcgagacacctgaagggcggtgaaccgaggatgcctgtgagcgtggatcggaagggtccatggtggctgttctggattcgcgttcaaagagctctccgtcgcgtgaataagaaaagtacggtccgcttacaggttcgccgtattcgctagtactgctcagaccgaagctgccaagctgatggttatagtggcggcgatgatctcctcgtcgcgaagactctcctgtcaagttgtcctctgagatgctctgacgcactaggccactacctcctattcccacagcgaccggtatcacagaggcggctgctatcgctgttggtggtgctatggtcagatcagggtgcgactgcgagctcaagcgcatatggcggcgacgaatggatccagcagcactgagatcgcgcctcagctgccctggaagcgagttcctggagacttctctagacagtcgcgcatgttgctccatctcaataattggtagtctgttgagtttttccctgtgccttttggaatagatgtagaggatgaaagggatgataaagttggcggtcgagacgagaaagagtgagctccagttgatgacggtcgtcaatcccgatcctgtcatgcatgggatcgcaattaaccaagggaggactcctgaaagcaagttggaccaaatcatgttgcaggcgccggactggatgaggttgtagcgaatgacaataatattgatggggacggacgtgatcagagccgcgatgggaaaagtgtatccggcgattaaagaaagggtggtagcgttgggggaggagctaatagcctggatcaaggacgagttgctctgtatcgggtaggccattcctccgacgatggcgaccataagatagatggtggtagtgatggtcacactccagcctacggtcttgtggatcgagacgttgggttgtttggcgtttgcccaagaagggacagtggtgataaaggcgtagttgaaaaggatcgtcccaaatgtttgcccaatatccgaacccactacaggtacctgcgtcgtgtcgagtccatgcatgaagaatgtcactatccattgtatgacgatcatgatcatgaggataaacgaagccagctgcagccagatgttttcgctcagcttgagaagagccaggggcaggatcatgacgagcgctaggaggacgccggcggtcattatcatgacgcccgagaaggggcttgcggattgaagttgcgcagacacgcacacgaaagacggatgtgggtagatctcgaagccacaggtgcgatgaaagatctggatcaagaggttgtcaaatagctgggcggagacagcgatcgacgcgatgttggttgtctgcatggcgagaaagcatatgatctgaaccagtagatgataccgacggccgaagaagcattcgaccaagttggaaaactccacctagtgtgagagcgggggagcaggttgagtatgaagccatttgtatatgtggtgcgaaagaagaataaaagaaaagaaaaggctatgggccgagtcaacttacattggattggaaatattcgtttcctggaacctcggtcatggcttcgcaaatgaacagactgctgagggtactgagtgttgccacgagcacgaagccgaggaccgtgggtagccaccctgcagactgggctacgatgggcagcgtgacgagacctgggccggtcatgttggagatcaagagcgcggtaccaccccagaaggagatgtccttgatgggatctgggtcgaaccggacattttggaagctggacacatggctccgcaccgagttgatgctgcgatgggacgagatgacggaggtgcggtgagactggttcgagacggatcgtgccaaggtcgttaggtgctcgcgtatgctgccagaatgcgcagagttggtcccggaccccgtagtcccagctgttaacggcggtgctcccgatggagaggatggacaaaagccagagccgaggggagaggggacagaaagaagctctgactctatcgtggtggccatgaacgaggcaccacctgaaaagagccttcaggggctgagtggcagcgtgcctgcgtggcgatgaggcgcgaggaggtgagtgaagaggaggacggaacaaaggaccgatgtcgaggcgacaggtcgacaaccggcagagatggaagaggctggggaaggctgggaataagagagaaagaacagacgggtcgtggccacgcctggtgcgagagagaaacaaacgtccggcctgttagtcaagagtggaatggcagaacgggtttgggcggtcgccttcctgggagggctgtctgttcgccggacgctagaaggttctatttggtaaggcacagaggactggcgtagtgaagggtgggtggagagcggcgaatggagactgaggaggcaatggagagtggacaatgagaaggagaatgcgcatgcgaatggcaatgtcacatgcagcaatcaggcactggggtgaccagcagaaagtgatttcaaggggtcggtcaaaaaggaccagagcaaaggaaaagagtgagaagggccggatgcgagagagtaaagagaaaagagagaagagagagagaaagtgtgtgtgagagagatgtagagagagggagagtggtgcagtggagctgaagagtgcttgatgcgacggagacaagggaaggccacggtgagcgaaaggcacaggaaggagagcgtggatgtgagaagatgccagtgcaaggagggaatgacacgaaggacgaagaaggcgcaagaggaggaagaggacgaagaagagaaagaagaagaggaagagaaagaagaagagaaagaagaggaagacgaagacaaggaaaagcaaagaaaagcaagacaagcgatccagaatcaccatcaccgctccgtccgatggcgggtgaatccacgcccccatcctcgcgctgtctgtcttttttttttttacgcccgccaactcgttgagacaggcagcctcagccgcgagcccttacgacaccctcgccgcacacgccccagctccatgaccgccacagacccaaagacggagaaaaaaaccatcgcaccctggactgggggcagggcgagcagggtgtccgcatttggaagttctgggcgtgtggacagcccgcggcggctaatcatcataaacagtggtgacacacgagacacccacatttggcactgtggtcgctctgcggtctagcgggctactgaataaactcctctcaaaaacctcgggcggctatcaaactccctttcagagactccgccagggttttggccacagccagagtcagtccactgatagcctcgcgtccatttcccttggagtgtctgggtgggcgagaaaagctctgagcaacgcagcatactatggctcctccctcctgctctccccttaggccccccccccctcatcgcgactgttataggccatgcttgccacctcccttgccctcgactcctgaaatatatgcatggcgggagcttcgtgtacgcgctagagagttaggttcaatgaccgatacgttttttagccacacacagacatgtaaaggagaggcaatgaaactgctcgactcatgagaggtagcgctacagcaagagacgagcgattacaataggtcaagaaaaagaatcagaaccacgtaggttttgggagtgggcactcgcccttgagacagtgatcgatgaccaaggctggcagattcgcgtcatagctgatgcaatttcgcaggctgaggccttccagcgtctgcgacagttctcgtgtcgctcaaccttttgtcgccaagtggcatccggatgcggacatgaaaggcatgctgacgtgcagcgttgaccatgtctaaacatccatgcccaagtgctttgaactgagaagcgagcagatgttgtattgatatgacgacagttctatgtatgtgtttggttagcacgtattgtgaaaggcatagcgccggccttgtgggacctagactaggggaacccagtcgctcctctcggaggtttgggtgcgaggtggctcctgccgaacctctcttgctatggtgtcgaggagcattgtcggccacatgaaggcccagactccgatggcgaggacaagcgggccagcatcaagcacaaagaggtacacttgtggtgaacatagcaggaaggaagtaggttagctcccgagacttggaatcacaaatcaaccttatcgaccgagcgctttctgtctctgaagcgtatgcttaccttcatgactgatgaggtatccgctgtagccctgggtgaactccacaatacgatacacggagcgcaactatgaaacaactgatgaaagttaaccaagtgagagaccaagagttgtctttgcaaaagaaaagtgatgcgacttacgatgatgaaaatgctggagaagtaaagggcgttggcgatgaacgtggtgtttctatcgaggccccaccagcccgttcctgcatggccgctcgagttcttctttcggtcggcaatcagtcgcttcaaggccacggtcaaaagggccgtgaagagaaggtaggagagaccctgggcagagacaccgacaaggaacaagttgtcgcccatctctgccagctggtggttgtcggatcctcctgctgcctgaagacctccagcagacatttgtatgaaaaatgtgatgatgtctgaccaaacaaaagtgcgtccgacgactcgaggcggtatgaaagagaagcgcgatttctccatccttgactctggagctttgccatcgttgttgccgaactttggatcaatggcggtgatcaagcgaccgtagagcatgtagttgaatgcgaggaaggcagagggtgagacaacgacgaagagcgactgggtaatatagagaccgaggctcacgtcgagaggatcgagtgcgagtctgctaaagaatccgacagcggaggccaaggcaccgatcgggagacacagtgcccacttgtcgctgtatctccagatgtagatggagtaggtgaagccgaggattgcgtagagtccaccaaagatggcattgcctgcaacatggggcttgtatttgagaatgccggtatattctgtggtaggtgctgtggcgttgggcgtggactgggcagccactgtgctcatgagcaccagtgcgtagcaagcccctatagacaggctgcgggcagacatcatcgcggcaagcgattattgacggatcgaggatgtagtagacggcgaggaggcgaggcagacagaacgataaataggctgtgtgatcggaacgtagactgtaggttgagcgagatggaatagagagagagtgagagagagagaaggagagagaaagagagagagacgatggagcttgctttttctgttgacgacgatcaacgtgcgtcccagtttttatacgcgccgacccgcgagcaagtgcagggcccagtggagtggtgaccatccaaactgggcttcaaattgcttaattgcttatcaagcatgggggctggggatagcctggagagcgcgccgcgagcaggctgcgtgcgagctacctgcgtgtccgaggcgagcattgagcgtttgccaagagggaacagccctttgtagaaatcaaagtttgcaggctttttttcgcataaatacctccgccgtaaccccaccggagttgttctctcttctgtcccattgtgtccttttcgtcgtcgttgtttgtccatcggcgtgcccattccgcttcgcattgcgcacctccatccgtcccatcgccgtcgcatctcccattcccctgtcttggctcttgccgccgcgctcggacttaagtgtacctcacaaaacagttggtcgttcttccccacttcgctatggcaaaatccaaacccccttcttcgtccgccgctgcatccttgtctcccaacaacccaaacaaccctgaccaccctcacaaccctgagcaggacttcgcacaacagccatcacccgcagccaaaccaccagcgaaacgatccaagcgtcctttagccaagcgcagctgcctcaactgtcgagagaagaaggctcgctgcgagcttcccgatctctttgtgccatcctcgcacgaccctgtgcccgtgtccaaacgatgccaccgctgcaacgtcctggacattgactgtgtggtgtgggatggagacaggaaacgaaagcccaagctgccaccacggcggaccagtgacgatgccaaacataacaactgcagcatgcccgaagtatggggaccacttgcgcaactcgtcaacgcagcagaggccgtggtagcagcacagtcgccccccaccaactcgcaggcatcgtccttgaacttgatcgtcagtccatcaccccaagctgtctccacctcccctgcactttcttcgtccagtcagttcttccagatatcgaccgagcactttgctggcactgcatcgcgatcacagacgccatcgtcaccctacccgaacgagcaaagtggtcgcacacaaagtcactccagtcccagcagtcttggagcacggagcccggccgcgaaaggcaaaggatcgcaatcgaatcacagcggatcaccgagagggccctcaacactcggcccgttgctcgttcctagcccggacaaaggaagcaactgttgcccccagaaatcggttgatcgggcatggcgatcggtgtggaggacactcgctgtgcttgtggactatgcctcgcagcagccgcagtttactcagtatcttctttctcgagtccactccccctcctatgggctgcagcccattgatgcgatcgatatgcttgacagacaggagtgcttaaggctaaagtcgaggtaaagtgcaactctattcttaccatgttcaactcagggtttaaactctcattctaaccagtgctcatcgtatttagtatgaccctatatctagcctggcacccccacctgccagtacttgactcactatacgacgcccatagtcaccaacggagcaaagcgtcattgctcctcctctcatccatgtgcctcgtggcatctcgacattgctatgcacagtcgtctaatctagtaaggtctctgtcagccttggtagaccgtttagggacacaacttcttatgtcgtccatgcgtgacatacggatagtgcaagcattcgagctactactggcccacgaaccaagtcttttgggaacctccgcttgtggtggccaaggcgatcaggccgcaaggggcaacggcgtggcaggagaaagtgttcttacggctgcactattcgttgcccgagagctcggccttgacaggtctgtgcaagtgttacacaggcaactgaaccgtcccaaggagattttgtgcgagggccagctctcccagctgatggttgctgcctcgctctggatgagtctacggctctgggagggtcactatgttctcctgaagtccaaactgcacgtgctaaatgatctgggcgagttggcacaacaggcaaactgtatgacctgcattgacgagcgtggaaaaaaggttgtgacaacgtcgctcaacgtggataggttcgtcgatggctcacttgcaggtgaagttgacgaagacggagagaagttgcgctcagcaggtaggccacatggagtagtgatatatggattcgaatcactgtgcaccactatgcagcacatggatgccccctactgataatttgctcgtgttgtattctttatccaggccgtacgattcttgtctatagaatgaaggccatggccggcttccacgggacattggccaaagtggagcgcatcctcgattctgcaaaaagcgaagaccattccatgcgaccggaggcaaacactcaccacataaaggcccgcactaccagtagccaaacaaaggacaagattgtggatgtcgtgaccaatgctcttgaggaaagacagcgaattgagcagggcaagcaggtggatatggccccatttgccttgtacccgaccgccaatttgatggaagattggtcccagctcgagtcgagcactatattctcgatgctctgtaccttcagcatttgcagtctctacacgggccagttcgactctggattctctgccagggatttcgtggactcactgcaacgcgatccagaactgagggaacgcatttcgattctgggcaagaaccgcctcgagctgtctgaaaaattggtgtcgtcgtttgtctttttcaaccgtcgaatgaccatccgaggtgtcgctgcaacacgccagcgaaggcccgagggagtcattgaggcgacaggggcacccttatttctgacatgttcacttgtggtggacgcgtgcaagttgtttctagaaggagctgcctttgttctgatcgcatactttgtcatacaagaatcctctgattccaggctattgctgatgtctcaggcagctcagagactagaggaatttgatgaaaaccggtacacctacgatgatagccctggtcaccaagaggaccccgatcatccacggccgctcggcatttgtgggattgcagcaaagtacatccgagaaatggtcgagactatgcagcgatggaggctggcttcctccatctatcgaaggcctggcttgatcaaaccccctctagaatcacccccggtctcgtcgcccacggttcagtcgcagggccctgcagctttcaacgcacacagcaacgctccgtccactgcctatgcatttggccaaccaaatgtgccgctggtcacaccggccatgtcgcattcatatccatctggaggccatgggcttcagtttcctagcatgccggacttgctgacttatccgcacccgttaccagcagaaaccatgcctggcggcccatcacaggccccattcacattcccggcgcaattctggccaccagagaccgagtttacaaggggccatgggtccctggattatctgctggccagctcctatccagaacagacccatgcggcgccagagaccactggctggcaggatatgcctgtgttgccgatgtttgattcctttttcttcgagacgctctttcaacaataaaagctctgccgttcaaatatgatttaaggggtgtccagtagacgcgttctaacaacgacgcgagcaagtgttttttgtccaacgacttttgaatctctccagcctacattcctctctcatccgtgtcactcgagcatagcattcagaccaccactccatcacgccttcgaatcagaacctgtgctcacgatcgcatctgtgcacaagtgccatgtcggacagtgaggatgacaactttgccatgtcgcacgatgaaagcgacggctatgaacctgaggctcttaaaaaggtacggccccctttaccccccctcttacgaagcagccgttggcttggcgccatttctaatgtcactctcgtactcaacagaggaaaatgaatgaacacagcgaatacattctaagcgcgcttggaatgccatgtgccgagcggaaagagaaagactgatttcgtattgctatgactgttatcacaaacgcaggtcgtgaagccaaaagctgcccccaagaaggctgctcccaaaactgctccgaaggccgcttccaaggctgcgcccaagacaggggccaaagcaggagcaggagccggcaccgccccttccaaaaaacgcaagttgagcagcagtgacattgacgaggacgcgaatgacagcgacgacgcgacgccacctgcaccgaagtcactcaagaaatcaaccgattacaatgagaacaagacaattgaggagatttaccagaaaaaaacaccgctcgagcatattttgttgcgcccggacacgtatatcggcacaaccgagatgaaccagcagatgctgtgggtgctggatccggattcgtcaaagtttgtgaaccgtgcggtgaatatcgttcctggcctctacaagatcgtggacgagatccttgtgaacgcggctgataacaaggtacgcgttggatcaaggtttatggatcgggacaggatcatgtgcatgctaaatgcggactaccggcctaacatcacgcattttctctagattcgtgacccatccatggatacgatcaagatcgacattgacaaggagaacggacgaatctctgtatacaacaatggtcgaggaattcctgtcgagatccacaaaaaggagggctgttacgtgccagagctgattttcggacaccttctgacgtcgtcaaactacgacgactcgcagaagaaggtcacgggaggacgaaacggatacggagccaaactctgcaacatcttcagcacggaattcatcgtcgagacggctgacaagtcaaatgggctcacgtacaagcaggtcttcaataacaacatgtcgaccacagggaaacctaagatcaaccctatgaaaaagggcgaggaattcacccggatctccttcaaacccgactttgcacgctttaacatggagtgtatcgacgccgatctggaagcattgctcaagaagcgtgcctatgacatggctggatgtgtcaagggcgtcaaggtgtacctgaatggcgaacgcatcaagatcaaaagcttcaaggagtacattgagatgtacatcccggtgcctgcagagggcgaggagaagccaaagctcatctacgacgtccctaacgctcgatgggagatcgcctgtatcccaagcgacggccagttccagcaagtcagtttcgtcaacagtatttcgacatccaaaggaggagttcatgtcgactacatttcgaaccagattgtcaaggagctgatcgcaacggtcaagaaaaagtccaagtcaacccatgtcaagccccatcacatcaaaagtcacatgtgggtctttgtcaactgtttgatcgagaatccggctttcgactcacagacaaaggagaatatgaccctgaaacaatccgcttttggctcaaagtgcgaactcagcgaaaagttcatcaaggacattgtcaagtcgcctattgtggatggcgtcgtcaactgggctgcttacaaggacacccaagctttgaagaagactgatggatcatccaaccgacagcgcctgaccaacgtccccaagctggaggacgcccacaaggccggacgaggaggacgacactgcaccctgattctgaccgagggagactcggccaaaactttggtcatggctggattcagtgtcattggacgcgatcactttggtgttttccctcttcgcggaaaaatgttgaacgtccgtgataccgccactagtgccgtttctaccaacaaggagatcgcctacatcaagcagattcttgggctcaagcaaggaaaagtttatacgagtatcgacgatctccgttatggtcatctcatgattatgacggatcaggatcacgatggatcacatatcaaaggcttggttatcaactttttggatcactatttcccttcgctcctccaaatcccgggattcctggtcgagtttatcacgcctatcgtcaaggcaaccaagggtagagagacgcgctcattctttactattcccgagtatgaggcatggaaggaggaggagggtggtgctcgaggctggaaggtgaagtactacaagggtttgggtacaagtaccaaagaggacgccaaagattacttcagtcaaatggaacggcacaagaaggagtttgctccgccatcgcaagaggcccgcaatctgatagacatggcgttcaacaaaaagaaggcggacgagcgtaaggattggttgagccagttccaggtacgatcgatttcaagatgaatatgccgagctaaatatctgttatggcacattgctaacggtagtgtctttctttttttttttatactttagcctggaacttttctcgatgcccgcattgacaaaatcccgattgaagatttcatcaacaaggagttgatcctgttttccatggctgacaacattcgctccattccatcgatggtcgacggtctcaagcctggtcaaagaaaggtcatgtacggagcgttcaagaaaaaaattgcgaacgaaatcaaggtaaatacgataggcattgcgttggtacgacctgcctctgaatgtcgcagcgaccctgagatgatcatgctgatgttcgccttgcctctctggtcgttacatgtataggtcgctcaactgagtggatttgtatccgaaaagactgcgtatcatcacggagaacagagtttgacgatgaccattgtcggcttggcgcaggacttcgttggcagcaacaacatcaatctgctttcgcccaacggtcagtttggtagtcgaatgcaaggaggcaaggatgccgctagtcctcgttatattttcactgccatcccgcccatcacccggcgcatcttccacgtacacgatgatcctctactcaactatatgaacgacgacggcgactctattgagcccgagtggtacattcccgtgattcccatggtcctcgtgaatggttcggacggtatcggtacaggatggagttcgagtatccccaactacaatcccaaggatattatcgagaacatccgtcgcctgatgaggggagagcaacaagtcccgatgttgccctggtatcgtggattcgtcggcaaggttgagaaggagagtgaattccgatacaaggtttcgggtgcgatcgaggagttggacgacaccacggtcaagatcacggagctccccatccgcacttggacgacaccctacaaggaacaaattgagacctggatttctggatcggagaagactccggcttggatcagggattatcgcgatgatggtactctttccaggatcgacctcacaatcaccctaacccaggaacagatgcgaaaggcgcgcgccgagggactagagtccaagttcaagctcgttagctccgtagctacctccaacatggtgtgcttcgatccccagggtcgtatcaagaagtactctagccctgaggagattgtgcaggagttttacgaccttcgtctggagttctacaggaagcgcaaggtacggcttgctatgatgcgtagaagagcatcggtacatggatgtgctatttttgcatttcgctgttatcgttcaagcggtatcactgctctcgactgaccacttggtattgtttatgcaccataggactatttgatcgatgttctcaccaagcagtggatgcgtctggacaacagggttcgattcattttgatgatcatctcgggtgagctgcaggttcagaaccgcaagaaggccgtgatcgtcgaagagttgcgcatgaaggggttcaatggcgtttcggaactggatgtggagattgacgctggagatgctacgcctgccgaaggttcagacacaggggcaggagtcaaggtcaaacccgagaggggcaacgaatacgactatctcttgaagatggcgatctggagtttgacccaggagaaggtggaggaactcaagaaggaacgcgatgccaagaatgcggaactgaagattctgatcgacaagtctgcgtatgatctctggaacgaggatctggaagcgttcatggttgcatgggaggacgttctgcagcacgatatcgacgaggcgaactatatgggtgctggattcaagggcggcaagaaggccattgccggccgaggacgagccgttggagccaaagctgctgcggtaaagaagaacaaggacgacgacgactttgaggacaagaagcccaagaaggcgcctgtagcgaagaaggccacgcctgcagtcaagaaggagccatctccaccggaggtcaagactgaggtcaagcaagagtcgatatccaactttttcacaaagtcgactcctccctcgtcgtcgtctgccccatccgccacagggaaaaagcaacaacagtcgatctatgacatgatgaagagcaaatccaagaatggcgatattaaggatgagcccgaactctctgacgatgcggtcaagcctgtcaagaggccagccaaggcgcgatcaaaggtggtgatatctgatgacgatgatgacgaggaagacttcgtagtgtctcgcaagcgtacagggaacgaaagtgacgacgacgtcgagatggacgacattgtaatggcgcctcgtgagtcgtccgtctctcgtgcgccccgggcagcgcgcgccaaacgtccggtgattgtggaccaggattcagactttgaggaggatgacgaatcctttgtgcaagtgtcgatccccagacgatctagtggcccttccactccacgcaagatggccaagagcatcgagcctgaggaatttaaggatgacgacgaggacgaggaggtaccttccgcggcactggactcgagcgaagacgaaggatatcaacccaagaagactgttgccaagaccgcaaagggcaagagcacgtattcacgcgcgaggactatagttgaggactcggatcaggatgcgagcatggggtctgcggacgaggacaaagatggccagaacaatagcgatgatgacgacgaggatgattatgtggagtccaagcccaagcccaagcccaagagccatgcccccaaggccaccgccaaaagcagcgcctcgtccgccaagccagcgaatggtcgcagttcggcgacgagcgctgtgaaaaagatgttttcgctctcgaacgacgacgacgacgtggaggaaaacatcgatgatctggacgaggatgctggtggcaaccacgaggatcaggaccatgcagacggatcgggacccgatgaggatgagaatgatgacgacaacgactcgtccagcgccggcaagaaggtgttctcactctcgtcccccaagatccctccagccatcgtggatgatgacgacgacacgatgttttcgatcacggcaccatccaaggtcactcaagtcaaaaagagaacgcctttgccccagagccgacctgtgaaatcgggaggcggcggttcgagcggtggtggtggcggtggaggcggcagtggcagcgggggggcgtctggacatagcagtgccaaggtgagcccttctcctggcggacttgtcgcgtcctcttcctcatcgttcacgggcgactcttccttgggtgctgtggcaggagcaaagacgctgtcgtcgtccgcgccagcgaaggcgatcgccgccacatcgcagctgctcgcggagctggacgatgtgtctgtgctggtgagccgagcaggccgtccacggccaacgtccaagaagcccaagtatgtggacattagcgacgacgacgactagagcgacactgcggcactacgcacacaacacagaaacgccttcgatcgccacagcaaatttgataacccacaacacaggaacaacttcaaaaaaagaaaaaacgtatatgaaacttaataaactcagctaaaagtcttagagcactatccatccatatggcgtttcgtccagtgatagtagtagagcagcgcacaggcaggctggcccaggatggtaaatgaaacccagaagatcatgttgccgaggccggaaccggtgcctcgccatttttcaaggggtcgagtgaggatgatcaacgggatctggaggaacatgccggcaaaggcgtatccgtagatcatatgggtagggaagccaatcaggatctcgtgcaggactgccgaaatgaagaagatgacgatcgaggcgaccatgggcgaggtgcccgtggtgatcaggggcaggtacacgtggcgtttgaagaacgtgtagacgggcgagttccacgtcttccagtacatgcccacacccgtggcattccaccaggcgagatagaatcgacggtctccaaagtacaatgcctaacgagggaaaagaacaagacacgagacaggaaaataacataaggtcagcattagaaaaacagcgctgagtgaattttaacgacaaggggggagttcttaaagtcgttgtaggcaagacttacctctgcaagagcgttgaagaacgaatggaaaaaggtatagaacatgagcagccagatgatgacactggtggtgctcagcttcagcactctctccagaatggtgccgaacgccagctcatcgaatgcgcggacagagttctgtagggtcggggtggcatactgctcgaccaaaaagtacatcatgcccagacaggtcacgatctcggccacgcgcttgaggaagaaggatttacggaagacagtggtccttgggtatgatggctggtagcagagagtgggggccagccagaagtaaccaatgttcttgagagtgatgttatcggggtattggacatcatactggaagatttccttcttggtcaggtccttgcccgagatgtcgtgcaccttggccatgtgttggaacgtgtcgacgggcgttccaaagatgtaggctgctcggagttcctgattcacgagcgcgaaggaggtcattttgaggaaaaggatgagcccgttcatgaggcaggacatggccacgaaggggtggtagatcataaagtatgacatgaaggagggccatgcaacgatcgtgaacagattgaagacgtggagccagcccacggtcgattgttccttcctcgcaagctcctcgggtgagagatcctgacccttggcggattttttggttttgagagcgtcgtcatcgcctcctgctgcaacggccttggtggattcctgcgcaatgggttcgtcggatcggcgcttgcgatagccgacggctctctctttggcccagctttccagcttgtaggctaggatgaggttgatgggtaggatggcgtgggtgagggcagccaggatccagtcctgcctggacacgctcgatccaggaatcgagagcagaaagccgtatttgaggtagttttcgatgatcagtcggatgttgttgccaaaaagcagaagcactaagaagcggccataacgagacaggaagggtgagtaaaagaaagtcgaaacggatgccacgcaggcgtgtgcccgactcgcgaatgaggccgacgaaggcgaaggccacacagccaatcattggtgttcacgctgctctggggccaatgcgatggctcgacactatctcgtgtatatcgcacattcatacgcgtgaatgtgcgtgcatctcctgcgatagctggacgatctgaagactgggcgagggctgtgttatcctgtttccacaacattgtatcacctcactgcatgcttttgcaagaccgttcagtcccagcggaaccgccaaaaagcgcgcaacaggcacgctttctcactcccagggcaaaaagcgcaatgcgataagagggaggggaaaggaaaggacagcaaacttactgccgaggttaacgaatccgcggtagctctctggaggggcctctttggacaatgggctggggatggttttggtgtgaacggggaaggtgtgcttgtaagaagagccggtcttcttggaggacttgaggtcttccatctttggaggaatgtcaggcaaagcagcgccgttggcaatgctctcctcctttgcacatgtcgtggtggtcgactctgtcatggcgcggagaggaaaaaaagtgttctgtgccctaacacatggaggatcaatggagcatgtgaacaagagttccagagggaattttctttttacggcatccaggtggcacgatacggaacgtagctgtgccctcgaatcgtactgcctcgtaagcacatgcacggaagccagtgattacctgattgaggcgcgagcgtgtcgtaaatgcgaatgggatcaggagaatggcaaaaaagaaaggaaaaaaagaaaaggagagcacggttggagaagagagagcagaggcaagagcgagacaggcagagggatagggtgagagagtaagaggggaggcggagtgtgaggaaacaaaaaaagaaagaaaaagtaaaaggaaacaggcgaatttgcgatcgcatatatacgacccagattgccagcggtctggccggcatgtgtatgtggatcgcatcggtcctctcgggaacacatggctacggagatacacctgacagctatgcctccactgccttggccttgcttacggtccaccctgccgctcagaccttgcggttctaaaaaaaatatcggccatccgagagccctcttgccattattgaccatgagcacgagaagacgaggaaatgcgacaagaagcaaagcgagccaaggggctgccagtccgatcgcttattgtgctgactgtgcagttctctcgctcgttcgtcgcatgcgccgaggataacggttacagaagtgactgaacacctcccccgtccctccgttggcatgcactcgtcaaatgcttctcaaatgaaagtggtacaaaaaatggaacgattggttcttcatatggcctttttctttgcagcaccgccagtagcacgtgagaaataggaggtgtgcaaaaagtgccctcttggatacccccatatgggactatagcccagaatcacgctctcaactccacactgggattttatctcttgctctcacctgaaatattttcacagcccgcttctccacgcacatgtcgtagaaagatagaggcgtggttcttgcgctgctgcaccttatccacgagggacaagggtcatgcttcttctgggccagcctcgcctcagctggaccgttcgccaacgcctgagaatcagcaagagagagtgagagacagaccctcgactttatttatgcaggtccacagctgacgggttgataacaacactaaacacaatttcgagggaaggagaggagggagggaagtagaaaattaaaggatcgtgtttcttgcgtaatcggacgacgcgagtaatcatcttgcagagaaaaaaagtcaataagggggtcaagccaggcccaagattgttttacggaagaacagaccatccgacggaataggctgcaataagcatggcgagaaggagcaacatctggaaagtgcccaagatcatgtcgatgatgcgactttcgatcaagagcatcaggatggcccagaggaagacgaccgcaagctaaatcacatggaggagggacgaggagaggttagagtgaacacaaaaaagaaagctgcaggcatagcaatttcttatcctacggcatagacgagaaaacgcgagacctattttggacttacatagatccaactgaggaccaagatcacgacgcctgacccacgacctatatcagaatgtattagacaacgatacggtaggcggtagcatgaagcgcctgatgcatcgaatgcaaacctccaagcacgtaccgaatgtattcaatgtcacgacgaggagcagcatcagcgtcaagtctcgaaccaagttgtgagttctcaggatcctgtctcgctgtcccaaccacgagggttatgtttatagtgaaccagccgttagttggatgatcagtttcatccgtctccgaccaagggatcgcgattctaatccgcaaaattgtatcacagacttacaatgttatccattgcgcgcgaaaaaaagcctgtaggcgccgttcgagcagtttctggagcgtgagcggaggtcgatgtcccgcctgcatttgtcgttgcagcaggaccctgctcgcctccctggatcggcgccactcccaccacataagggccatggtcaagacccgttgtcactggaggtcccgtagccacacggccagtgggtgggttggtctgcgcgaatcttactgcgccgaatgtctgcttggccaaactgaaataagcatataacttgcagatcattagcaagatttacatgaaaggcctgtctgtaatcgggggtcgggtgtgcggaaatgaaaactcacaataggagcgcccagaggagccacaacacccacagggcgatccaggtgtcacgcacagagcgccgtccaaagaacgtggctgcatgtggactgttgtcataggcggggtaagtgggtcctgtggacgacatgaaggctcaagaaggatgttcaggcctggaagctgtggagtggatgtgagggttgaagtgtgaaaagacgcgagtgcgggtctttttctacaaaagagaggggtcgtcatgctgtgacaagacagaagcaaaaaaaaaaactcaatcaccaaccactggggatgaagtgctcaccaggtcgggagcatcaccatagccatcatcatctccatcactcgcactcgtgcaccaagagttagccgattccggctgtgtctcacaggcaaaaaggagaatcgacgcgtttattgtctgctccgcgttcgatatatgctgcgggcgggagagtgagtagtcaaaaacgaaagaaagaggcgagcacaagagctgaggcgcatccacggctgtatgcattcttgtccaatgaggctgttcgcagaaggatcatgttaaacaggccacatggcgcaaccacaggggcaaggcggatggctccgcgcacatgcaccctatggcacgcgggcgggcactactcagtgtcgccttctggtccgacgcagtctcgaagcaatactttcatcttcgtcatccgactcctccatctcttcgtccttattttcctgctcccctccctcctcgtcctcatcctcgtcctcttcttcatcatcgtcctcaagcgtcgctggatccgtcttgtacgagacgggcttgccgcttcgagcccttagagcgcgaccacggatgttgctgaacttgagctctggctattcatcacgacgagaaaagcaaggatagcaacaaaaacgcgtcagtgcagcccttagaagcagacctccatagactgacaatttcaacattcacatgagccggttgacttacctcctggcgcgtcttgctttgacgactactgcgctgctcatcctcttcatcgtcgtcgtcgtcctggtgatcgccctcttgtgccttctcatctcccgcttcgtcttcttcatcgtcgtcgtggtcgtgctcttcgccttcctcctcctcgtcatcatcctcatcctgtatatggtcgttcgcatcgtcgtcctcttcatccttctcccgcacgccgtccgaatcctcctcgttctcgtcatcctcatcggtctcgtagaccacgcttgcgactgcactgatgcactcgtccagccaagcatgtagcgcaccgaaggtcttgacatcctgcagcatcgcgtcaatacggcacgtcctcagccaagccaagagtcgggggttgacggaaacaggaaccgatagcaacgcagctgatgagaggctctctgtgccattctcctgaacaatatccatggctgtctcgtccgcttcctcgatctcgccggccactggctgcccctccatggcctgcaggcagtggtttaagaccttgatgatggctagtagttgatcgatttgtggatcctgtgatgcagcacgcactttctggatagctttcgtgagcgcatgatcgtctccattgcaaatcgcacccgagagctcctcaagtcgttgctcggccgcttggacaatcctttcaaagtactcggacggagtgggtcccgaggtcagatcctcacggacagcggccaagaagccggcctccatgtcttcgtcaaccaactgctgctgttcggagctgtcgtctcccatctccagatcctgatgtgcgtccacgtccatggagtcgttgtcgtcaccagtattgcccatggccgcagccagttcctgtcgcgtcgccgcgatatccgcaagttcctgcttgctcttcctgccctttttcttcagcagcatcacaagttcctcctgggacaaaggttgaccaacggcaccgaggacggaaaccgtcggctgattcttagaggtatgctcacgtccagcccaggttttgatcagatcaaagctggcttcaatgtccttacgcatcgttaccaaggatgccttgagaacgcgctcccgattgcccttgccattcagcgcccgggtcaaagaggccagctccttggtcgtcgagataaggctccaggtttggaccggtccgtaatccaagaggtcccgttctggcgcaggcttgactggccatgcctgttgctgggtctctgaaaacgggtcctgctccgtgggggacgtatcggacaagaggttggcaatcgacattcgatccctggtcgtggccaccttatcgccagccaactccgggtgcgccatagtcttcattctttgcgtgacatcgtccaaggactcttctgccatcgaggtggcctggttctctctatcggacgtgtcggacgatgtgcattccgtgctcttcatctgagcatcctgctccttgctatcgctgctggccaatgtcgcatttttggcttcggccacgtccaacttgggtcctacttgagctcgatcttcgataataacaccgccaaaattcctccaaaaccagtatttacgaccccagcgatcgcttcctaggcaaatgaccctcagcttctcatccgtgttcacaacataacccccgcggagtcgggtccagggcacattgttatccttttgaatctctgtgtcatcaagcgaaatgtcctcaagctcctcctttttcgcctcccaggtggtctccttggccttcagatcagccacaagggtcttttgctgagcgagaatgtcgttgatcgtgcggcgagcgtccttggcctgtgcgagacgttgctgtctagagagtttggtgccaccgatctcgtcctcgcctggtccgtcgtaggtgcctctctccgacgctaatattccctgtcgcagtgtctccagttcagcggcctggcgttcaatggccttcatctccctctcgagctcgtgggtctgactctccagttccttgcggatctcagtccgcttccgcttttgccgcttcaaagtcgtgatgttttcctcgacctcatcccgcatgaagcgatggaaccgtggcgacgaggtaatgtcatgcaacgccttgaccagcgcctgaatgcggtccgcgacggtgtaggcagaatattcgatagtgcccagacgactcaagggagccgatttctttctggaggtcgtagagagagagctggaggcgtactttttcttcttcttgtccgcctttttttcctcgagagtggacatggcctcgggaccagcggcaagaaagtacggaaagttgaattgattgatcctgggtgcttgtccgtcctcgtaggcagccatgatcattttgcagttcaggtccaacaaacggtcgtcgatccttgggttgcggatcatggacagtaacagatcttgagatgtacgaagtaaacgaaggcggcgagattgtcttattagtgatccgatcgcttattgatcagtaaacagctcacttgcgcttgaaagaaaagctgccaatatggctttaccatatgtgatccattcgccagagtcctttgttaacccaaaggatgatccaaaggtattgagaaactcgtgaaccatcttcacatccgccagcatatccatgtccagctctggatggtgtagatccaacttgttgagtgctggcagtcgagagcttcgcagaagaagtgcgctcagcagatcctcgaagggagctcgtcccgttagttttggcagctccttcatgaagccgccgtgacgcctgtcgtcgtccgctgccatagctgtaaagtaggatccgactttggaaggatcgagcacatcgaatgagaggcaagactgtttgaacgcctgttcgacgaaaggatcggtctggattagtggcatgtccttgacacataaaggtctttgtatgcgaaaccatcccagcctttgtgtagtagcacggtacacacataccgacttgtttgacagagtggcagagtgggcacttggatgggcgtgctaagtgatacaatgtgtgaaatcgacaagagggagaattcgactcgttagaatgctgcatgtcgatggcttccgcgttgattctcaaccaattcttacacgcgcgccttttctcgtgctctctctctctctctctctctctctttctcacgatacttacttcttcaaggacagcatgcgattttgacgaggatgcagacgctgatcgatcaaagaaacttaggatcgatcgttcagtcttactgcccgacgacgtagtccctgatccatcgccatcgccaagcttggactttttctgtttgagctccttttgctgcttgggttccttgatcgctttgggttccttggtcgctttgggctttggctcctttgattccttggctgccctcggttctttgggctctttgggtgtcttgggcttcttttccttgggtgtcttggctgcagaaggatcagcctcctccgactctgatttgggcttgggctttctccctctctttggcttctctgatgacgccgaggcgagacagggctctgtaggagtgacggtggtgtctgtgggcgaagcagcagggtcgtaaaactgttgacgaagatcctgattgtggtgtgaaggatagggagggtagtacggttgctgacggtgctgatcaagacccatgttttctgcacgaactccttggccagccgcggtgtatccgtccctatgaacacggtgggtgtgaggtggagacgggttcatgtgggcataggtatggacacggtcctccgcaaaatcggtgtgcctttcaaaagcgcggtcgccttggggtgccctgctgccgtcgctgccgctgccgctgcccctgtcgaccccagctttcgcactgctgccactagcgttggacagccaggaggagaggagtgagttcttgggccgttgggtgggaggctggtgctgggccgatgctcgcaggtggtgctcggttggcagcatgggagctggcacggaggtcagcggacgaagtttacccggcggtgtgtttctgtggagagcatccgcaggaacggtcatagtgcacgcaggcgcgtcaaggagatgcgttcgagcgcacaggcgacagcagagcggggactcgcggtggatgcgagatgaagggtgaggtgtgaaaagcgaaatgcgggtggagaccaaaaagacacaaacaaaaataaagtcagcgaaaaacaatacgcaaaaatcagaatcagaaaggcccatttttgtgggacgcgtctcattgggcggaagaggccgccctcctcgtccgtgttctttgtgtgttcatcctttccctcccgtgcgtgctttgggtcccgtctgcagcagggcttcgcctcctcttgatacaatgtactcgagctgctcgtatgtcccccatgcgtcctgactttttttttttcgctggctgctctgcaccctttccaaagcacacccgatcgattgtcgatttgaattttcgcgcgtgttcccaatttcagtcttggtcgggcggtggcttgtccacctcctctgccccaaagggacagtgtcgcattcggcaaaatcgacgggcacttcggacaacttttttctctctcgtttctgcctggcctccactccactccactccactcactcctcatccgacatcatgctctcaaccctgggattgcgctcctccgtccttggtgcaggtacaggcccgggtctttttgacgttgttgctcgcatacgcgccaactcatcctggagcgcccttgacaggagacagacacggacatggacactgtcgttctggattcagatggatcaagcgttcaaagacgaccccgccattaattcgccactctgagcgagattgctgatcccctcccccatccttctctctccgttgcgcattccttaccatacagctgcccgcacctcgctcaagcccctgacatcgaatcagatccgccacttcagcttagtttccgagcaagaggaaaagggtaagccgcggtatcatggtttttttttgcatattccacgcgctgcactttctcagaccataagctaactctctcctgtctgtctctctactctctcccaaagccaatgttcctgcagcacagaaccgcaaaatgtcgactgctgtcgcaaaatcatacccaggacccatcagccagccctccaacgctgtcggtacggatgcaacgaagaaaaaataagaaaagcattgttattttcgctttatatctgtatgtccgcggggccaatgactgatgacatgtttgtctatcttcctgcatagaatacgcactgtcaactgtggacaagatcatcaactggggtcgtgaaggttcgatctggcccatgacgtttggacttgcttgctgtgccgtcgagatgatgcacatggccgctggacgatatgatcaggatcgtctcggaatcgtcttccgtgcttcgcctcgtcagtccgatgtcatgattgttgctggaactttgaccaacaagatggcaccggcccttcgtaaagtgtatgatcagatgcccgagcctcggtgggtgatttcgatgggatcgtgcgccaacggaggtggatactaccactactcgtactcggttgtccgtggatgtgatcgcatcgtccccgtcgacatctatgttccaggatgcccacccacatcagaggtaaaagagcaggacgggagctttttttttttggctttgtatcttttcagacgtttgtgtgtggatgggaaccggatcttggattatgagtgcatacattttaatcaccctttccattgctgtttcttaggccttgctctacggagtgcttcagcttcaaaagaagatgcgcaggagtcgcgttacaaccatgtggtacaggaagtaaagcaacagtataccgacagctccactcaaccagcaagccagcagaataaaaaaaatagaacattagagatttactaagtaacaaaatgcagatggtgcaagaggaagatagagtacaggttggaggccatggaggtccaagatctatgaagtataaggagggggcgtaaaggtgtaatgatgtcgacaagacatggacgaggagtggggaggatgaggcaggatcccattggcatctaggtttttctgtctgcccgtgacagttttggaggaacaaaccctctttcctgaagctcaacaaagggcttcctgacgcctctctggtgctggtactgggacatgtgaaagggtcacaacggtcggctcctctcggatgatgctcacggatcgaacaaagtcaaagatcacaaaattgagcgcgcctcctgggacagccagaatggctcgggccttggtccccgagaagaacttcatgaacccttccttcttccagatctccataaagacatccatccacttgagggatggcataggtagcttgacgcctgagccgttcgtgggactgaggcgctgctcggtctggatgcgtgtcttgaccatgtcgcttggcgaggagagcaggacaccggccagagacgccatgctgcctgccacagacgagatgatcagctggttgagttccggtggcgggaaggcgttggctgagtccgactgcatcctgcgtgtcaagtggatgccctccatgacccacacctttgagatctcgtaggctggaaagtaagctgcaaaaaacgggatggtcgacattagcgttgcgcagtagcctcggaacaggaatcgaacgccctcctgcttgaactgtagtttgagggactctgagatgggcatgggctgtggtggctgcagaggctcgtacgatcctgcgacaaagagcggtagcttggtggttgcggctgtggagttgacagcgacggtcaggggcgctggtgtaatcgggggtgcaactgaagtggccgttgtggtcgctgctgcgctggccaggttgccctgggcccccgctttggcgatggtaatctgctgcgagacctagatggatggaaagacattgcacagtggggaatgtgagcggatcaagactggcttgtagggatccgagacacaaatccctctttggttctgcagagaaaggcgctgcagccatgatcaagagggagatggtgcacgcaccgggcacagctgcacagccatgtcattgaccaaagctctcaaatgccagcagcatatttctgaggttttggataatcatgaaatattacgatccgttcccgcgtttctccttttcaacaagcctatatgggtaatttgtgtttttcctgagcaaacattgactcaccatatcaaacggcacgacgaagaatgttgtcaccactgctgagaacgtaccgagcagaccgctcaggacactcgggcttttcaatgcctcgatcccaaagtattctcgctctttggtctgttgatgcagatagtcgtaagtcgcgaactgaaggatctttgtggtggtcaggcccaagctgaagacggttgcgcctgcatagagcgctcggaagccattcttttgctgcacgtccttgatgactgtaaagatggaggaggacactgggatcgaggactttcgttgctgaagcagacgcactgtcctcatggggtacatgagtagaatcggtgggacattgaggactgtgccgtataagtagtatttttggaaatcgatccgagccgggtccagggacgttgtgggcggcatcgtgctcggatgggagagcgatcgttgaagatgaggtgcctgtgtaagaaagtggacggatggacagtgaagagggcaatctgctcggtgtgctctctgatcggataggctttgctgaggacagagcgcagtggtagcgagacaagtgtgaagacttctctatagttggagcgagagaatgagcgagagagtgcgaggggatgaccaagggtatcgggaggagaagagaagagtagaccggttgaggcagactggcaaagaggagggtcggttgggcagggcagatgcagaaagcgcagctgcgatggaagaaaagcgatgccacggaatgcgaggcatccaggcaccgtaggcaggtcataactcagtagtgcctgtaccctctcttaaatggccgagctgaaagatttcttttacaaaggtgagcaagcgtcagggcgcgcgcccttgttgatcgataccaaactgtcatcctcagcaacctcaaacgagcctcatgaaacgaagtatgccgctgaaggcttcaacgaaccccatgggcatttatattccaacaaagattgtacgctatattagagacgcacaggctccgacaaaacgatccttcgacttatttacactatgtagtgcacattcgctggacataacgcgactttactgagtccaccagtcgggatagtcgccatagctgtagccacggccgcggctggaacccgaacagaatcctgcgcatgccttgtccccggtaccggacccacacgctctaatctgcttggcgaactcgtgtcgcacgcacttgccatggcctgcgtcctcacaccatcgcgaattgagagtgcaagggaaaagagtcgtatcgcgtgaaatgacccaaccactgtcaccaccgtcgatgatgtttgggcctagagcgtatgcgccgatggcaaggaggatgctgacgagaagaacgttgcgcataatgaaaagctacagtatcgacgcgtaaaaggtgttgatcagtaaaggactacctacgcgagatatgtattgcagataggtgcaaagtccacagaaggtggtcatggtcttacttggaaaagatctttttgtgttgaggctgtgggtctggggttctagatgaagaaactggacttgatggtgagggatggagaaaaaaaacttgtgagactttaggctactacttaagcagcaaaatgggcgcaagcttcttcgtaatgacaatgccgaaaatttgcttcagtatcatgcttgtagactagacagagtgtggtttcaaagtcctcccgcggccttcgtagaggaggcgagggccggatgcgcttagcccagtggttaataggcatagtccaagagtgagacgttatgcaccctcgtaggcgtttggaaaggacagagcaggactgggtaacatgcatggcatggacagcacgctactggcggggcagtggttcaagcagatggaggcacaagccgcttaaagtgtgtagagtgtcgtgaggggctatgaggtcagcggaaaaagaattatgcgcctcaccgtgtgatggcgtgggttgacggcaatgatcaaagctgtgtgcgacgcatgagcatagaaaaaagatagttgaaagcgcgtcagcgccctacgcgctaaaggctgcaacgctaaaaaagatgggaacgtgccatgacgtgagtaacaaatcgaaaaaccaattggctgttcaaaaaatgaaaacgcacgactgcaggatcgagccgggaatcgggcgcgttaaaaaactatgcacagcaccacattgaagcacctgggttactctcccaacgtactgcgcttagtccctcgccttttgaatctctacccacgccttttgaatctctacccacgccttggcacggtgcttcgctcatggatcggctcattggataagcgagatgagaaaaatgttcacacatcgtcagagtggatagggtgcgggaagcagacaggtgtggagtcggccgctctgtgcatgaataaacgcaaggggcacgggaagagtagcgcatacggcctcaacctcgaacgctacaacatccacctcgaggcaagttttctacgaatggtcgcgagacctacagagacactttcgcggaaactcgactttggctacgtttgtagcgcatagagtttggggaagtgcttgcagtgcgtccagggtcccaaggatagacacaagttgcttatttccatcgcagctcaagtaggaaataaacagatgcaagaacttcagccctctttgtcgtgctcgcattggcttttcgaccctcatctctacacccattgttcacatcctccaatccatcattccatcaccgccaccaacacgacaccggggctcatggcgacacaaggacgaccagcgcagcaccgcaacctcgagtgggacgccatcgcgcccttgacggagctccagcgccagggcgtgttcgagctcaaagatgcctgctcagagctgcccctgccccctaatgcaagttcctggagcagcagtgccgatcgcgagacgcgttctgatgggacagctcactttccatgctgaccccaaagttcgaaccccctccttcgcttttcatctcttttctcccttgctatagttggcagcagacctgagttcgcctttgccgtttagcaagtcgagcatcaacaacgatacgggacaagctgcaggcgcgggcgccaagctttctggaaactatcagcacctggttgggtcaccacctactcagtcttcaacaaccctatcccctcgatcgcatcctatcaaggaaccgaacgcgcttccgcgctcgaggcttggaagtgttgccaacgctgaaggcgtggtgctggaagagagcgagcctgatcagccggtgtgcatcgagacaacgcaacagttcctcgactggttctcgggcatcgaaggcaaaatggaacgggatcaggaggacgtgtacaggtacgcccatttaattcggcccatgctttgcgaaatcgagtaagcagtgcaagtagatcggtattgacatcgtgcctcctttttgtctcaggaattacctcatggttgtcctcctgtacagggatgcctgcgaaggatttctgaagcagattgacgaaacatcagagtgcttccagagtctcgagggacattacgcgtttgttgaggaaaagacaagagcccttcaacttgcatgtgagaagctgttacaggaacagaccagcctgcaaacactggcggatacaatggcgtccaagctctcttacttccaccaactcgacgcggtgacacggctttttaatgcaccgggagatgatgtgtgtcttcgaccagagtttgctcccatgctgagtaaacttgatgagtgcctgaagtacgtgcaacagaacgtaagtgattcaatgaagctctttactacatgtattgggctcgaagtaaaccagggcgatactgaagagtcagtaagctgacatttcagttttttctatagctcaagtacaaggactcggagctctatcaaatgcgtttccggcaatgcatgacacgtggaatgactctgatcaaaatgcatctcatcacaaagttgcgcgcgctgagtgcagaggtgacctccaaaaagccagttctcgccaaaggcgagtccatcaagccagccatggccacggccctgttctatgtaaagtttagggccattgcacctcctttgcggtccttggttgcagaacttgagaagcgatgtgtgtcacacaaagagtatgttcttggtctcttgagatggcagcaagacatgattattttccaaatgcaatattaacaggcattgaacgcatcacgttgtaggtacaactctcttctgaatgactgctacaactgctacttttcagtccgccagcaacatctctccacaatgatcgttaccaagatccaggaaatggggccgagtcaaagggacaagctgaaatttgtacgatatgaatgatgactttgatgagctgccttgtggctgcacaatgacactaatgcacaacgtactcttttcaggcacgcaatgggctagcatatttgacttcggtgtgcatggaggaatattccttgttctacaactttttcaacacaggcgaagaggagctttagtaagttggacatggctaagaatgtacgacccgcctttgttgtccacttgaatgtttgttgtgctaacccgagacgctcacttgcacgatgaacatctagtggatatctagatactttgattggctacctttacgattacctccgcccacggattattcacgagaacaagattgacatcctgtctgagctctgcgttgtgatgaacattcagcaatccgatattccaagtatgagccgtcttcattgaacttagcatgcagggccgtctggggtaacaaatatcatgtggaccggctctaacattacgtgtattcatttgtagttgatgagaactctcatcttgccttcggctatttgatccgcaatatgcttcaggatactcaacaccgactcgtgtaccgcgctcaagcgtttatccgatctgaaattcaaaactttaagcctgctcccaacgttctggactaccctgcacgacttcaaggtaacgcttgggctatctggctgaatgaaaaacttgaatatcgtcctcctcctgctgacactcgattcgatgctgcattcgttagcaccaccgctcctgcccaacggtactgaggttcctccaaggtctgcgtcctcccagcacatccatagaccttcggatgcagagagcactgcagaatctatacccgaggcgtcgtcaccaacaccctccctggcaggaagcatcacaggcggctatttttcatctcctacgcttcagcagtttgacgagtctgcagagatgtaccaaggatggtacccgaccttgcagaaaacactgtggctgctgacaaagatttacaagtgtgtcgagcagtccatttttgacgacctttcacaagaggcgctgtcgaaatgtctagtgtctttgaatcaggcctcagtcgctatcaaggagaccaaggaccaccaggtggatgggcatctgtttctgataaaacacctcttgatcctaaaggagcagatcgcgccctttgaaggaaactttgttcactcgaccaaggaggttgacttttcaaggatgacggatgccattacgaccttgttccgggaccggactaatcttttcagctttggatcatggtttggcgcggtgtcacagacgatcacaccgacgctcgttgacagctatctggatgccagacaggagattgatcgggatctgaagctcgtttgcgagacctttatcctggagatgggtaaatcggccgtgcattcgctggcagagtttatgaacaaggtggccggatttcggatccgggctgatgtggaagcggctcatagagagcaggatccttcagcgggtactgggctgatgaggaggccaccgatgctgttgaaggacaagccatttgcgagacctgaagagctggcgaggattatgatggactttaaggaatctgtgccgcctaggatccagtggacggtccggatgctgtccatgtacctgaaggaccccaatacggagatgatcttgatgcggccgattcagtcgtttatcattgagtcttaccagtcgttttacgacacgatactgtacgagtacgatcctgctttgactctgaaggcgtcgcagcatccgaatggacctcaaaagattcagcacgcgggtctggagagtctggagcctgtggatcgtgtggtgaactgggtgggcgagctcgtccgcacggagctcattaagaacaacccgacctttagcatgccacagcaataaaaagaaaccacacttgaatttatctacaaatgaatagattcgatcctgagcatggagacaaacaaattacagccaaaagtaatgatttgaatacaatagtacagcatgtcagtctcccactgccatgcgctgcgtcttcccggtttattgaatctgtcccaagtaatcctcctttatcgtgcccacagcattctaatgagaggggttttaagatgaagaagcggaaatatgtgagaaagctgaaaaaaaaatattaccgaaagcacaggaagattgcaatgctgagaacacgctcagacttacaatctgtgttgcctggtgcttcaatcctacgatcttgagccgcacttggccgttcttctcgatcatctagggcaggggggttttcgatatgaagactgtcaatactttgctggtcatgatttgtgcggtttccatttggagaaattcaaaagcagatcatgctgttggtcctgagcacaatgaggggcggaggaaaagccttgtttacctgatcgtctcctctgtagcaaggtccgttggagtcgaacttgaagtcgtttggcatcaactaaacgaggcgatagtcgagtgtccgttagcacgcgtgatcgccgtctccgatgtagactcgaggccccaaagtgcttgagggcccatgtacacaccttttgagccacaaagacctgaagagggcccacgtccgcaaagaatccaatctattggagatgtaaggaaaagaataaaaaagggtgtcagacgagagatgtcactgatacgacaggaagtaggcgatgtcgacgaggcggggttgaggtgttattttgtgttacctggttcacactcgtgacaatggcatcgacgacttcacccttataaggcttgaagacgatcgcctggtaatggaccacaaactctgcaagacccgagctgggcaagactttgcccgggctgatgttggtgacggtcaagacacagataatgaagcccacctttcctgagcaggtgccctcgacgtcgccgtgcaggttcctgagcaagaactctttcatgtgaggcccatagtaggacgggtggaggttgatcgtatgtgacagattgcgctgttgtggagcgacggtgggttgattccatcaaaggtggttgtgcaccgtagacacgtcgaacaaaaaaaatgcagttgttatgcagtgatgcagaagaagtcagtctcttggtcacgatgagcgtagcaatgcagtccgcatgacgcggaaggaaactggcagcgggctttctttttttttttttaccaagaagaacatggtgggcaaaggcgttggcggagggtcggtcgaatcctttgtgtcaagtccgttaactgcagcgcatgaacaaagagatgaacagagaaaaaaaaaaaggatcaagctggtatatataaatttgggactgactacgtcacacatttgattttttattcctcccgcaacgtcttgcggcaagcataggcatcctcgccatcggcatagtacttcttctcgatatcctggacactgtggacataatgcacaggtcagttagagacatgatcggatcgacacgagtgttctatacgcatgctcgtactgcttgaaatggcgcacgtacctgtatttaagagtgtccctgtagagctgcaaggcagcacggttgctcttgcggacgtgaagagagacgtatttgcagttgaagacatcgcgcatggcgttttctagatagaacgaataagaagattgatatcccagcagacctttgtcagtaccagtaggtgaaataggctcattcagggtccagtggaacgaccatcgttcttgtgagcagagaaacgatatcaagtcaagcccctcccgtagtgtgctgaaattctttgatgttgtggaagcttgctgacaagcccagctgtttctatcctgctggcttgctgaaactccttccacgtttggtttttgtgtgtgtctgtgtaagtatgttcaattgcatttggcggggatcactcacgcgactgtgtcatcagcttttcagcgactccgaggcgacggtatgtgcgcattactgacagcgacgtgatgtggccgtggggttctacggctggatcctcctcgctaaaatatcgcgaatgattcaaagaacgaaaggcacgcatgttagcttctgctgtgtgtaagccggctaaaaaaatgtcaaataattctttcagatcgactgggcagacagagtttccttacagctttgcgagaacgtatccaacgattctgcccttctcgtcctctgcgacgtatgaaagttgaggccatgtcaacgagtgataaaagtctaaaaaaagtgaaagtgatccgtgtcaacaaagcgtatacatacaaaaatatctcggtacaggctgtagatgacctttaagagtatgtcattctgcctttgcattcgcgatgtctctgtgaacgtacagtatttcatttggtagttctcgggcaggttgtgcagattgcagttctgcatcgggatcatgtcgtccagctatcgatcgaaaaggaatgtcgagtgtagaacacacagaattagatctcactcttttttcttgctgatcagaacgcggcaaatccgatcgaggcaagagtgggctcctgtgtcagacatcgcacgtacggtagcctcgcgaatgttcatcttggcgttagttttttgttgatgttggtaatgaatgagtcgatgcgttgatgcgggttggtggagtgcgatacccaggggcgacgcttcgaggcgggggcgtgactgcttgtgatgttgtgttgctgctccccgtaagagacttggcttgactgcagtgcggcaacatatatcttgatggccttgctctgtggatgcatatgttttcatgcggcaagtgcatgtttggatgaggcgatgcgggcccgcatgcggctgctgttgcagcagagacaggcagacacaggcagacacaggcagagacaggcagagacaggcagggaggaggagcgctttcgctgcatgtgttttggagcgaaggcagtcaagccaacggccagatggccaaatgagagtgcccgaggcccaaaagcaggcaagtgtgctgaatgcccgccaatcagcggcgctgcatctggctcatttggcaagcagcccgtgtggctacataaaggggtttccatgagagggcaaaataaaaaaagaaagcacactcgaccttttttctcactcttttttttttctctttcttttttttttttttttattattttgacgctccacccattccgcctgcttcgcctgctgtcgccctgccccttggttcgctatccgccagtctcgttcgtcatttggcccctgtcggcagtggtttgccccatccccagacaaacaccaacaacccgcctgcctggcgacgttgcaagacgcgcctctttggtcccaaactcttttttttttccttgcgcttgcgctgtcgttgtccctgccgtattgcttggggtttcccaggcacgcctgctcacctcccgcttcgccataacaacaagcactcacagccgacctgcaccgcacctgcgcccacgcgagataaccacaacccccatggccacgcaccacggccctgccaacgctggcaatggcactgagccccagcagggtgctcccctcgacgacccgcagtcgcccatcctaccgccatccgacgccgagtatgattcgaacgacgagcagcagccgcccacacccacgcctccaccgacagacgctccgcaaccagctccagcgcagcttgcacaggagccaccttctatggcacaccccgccaacaggaccctgcatgtccctgcgccgcttcgacgcaacaacagcagctccttctcggcgttctctgaaataccctcgctgcctgccttcttgaacaactgcaatctctcacagtacctccagtccttcaacgacgcaggagctgcagatgatgccctgccgctcatgatcgactttgacgacgatgagctcaggagtgtcatggaggccgttcccatgaagccgtttcatgctgttactttccgcaaagggatccgcgagctgcgcgaacgcagccgtctcgggtccatgcactttgacaactcacagacctcgtttatgcaagtggagccccacagcacactccactactcgcactcgcagttcttccagcaacactcgcagcactcccagccatcgctctcgcaaaactcgtacccctcccaaacatccatcaactcgtcgcagcccgcacgcggggtctcctttcactaccagggaaacaacgcgcaaccgccatcactgtatcggcagccgtccaagagttcagcccagcccacctctcaagcgcaaatgcccacgccgtctcaagtcctgcagtctggatccctctaccagtatgtcggcccagcgcctcgctcagcgacaggcaaccagcctgcgcagcctgtccctctcttttctgaagagcaacccaatctgcaacgatcgaacagcaaggtaaaccttggcaccccaaccaacacttgtttggcaaggaactgtaagagactcgcgttgatcatttatggacttgccttttttttttctttatccctctatagaatgagcatagcagagcagccaagcgtagacgctcctcctccgtaacaccagcggatgcagctttgggcggtacatctccagttttacccgaaccgagctcattttactccaactcgtcgtcttcctggaccggcactcccaacacccttccaggatcgcagcaggaccaggcgacgcgggaaatgatcatgcaccaagccttgatctatggcaagcactcgtcccggtccctgacaaagtatgaggacgcgatcaaccgcgcagctcagaccctcgcactggaagagcccggcttgctggcgaacaagggccagttgtggaacagagccaaggccaagctgctggaggaagactacgactacaagcgtggaaggtcaaggtccaagctgccagaggcatccaagaaaagagacgtcaaacagagcaagacagcgctcatgcagaagagagaagccaatgcgtcgcatgcggcctctgcgcggatccggagaatcaactctttgggtgaacagatgcaccgcaagacagcggagcgggaagcgctgctcgctcaactgctgcgactcgagtctcctgaatacaagcaggcgcgtccacacacatacgagggcgaggcgcagcaggcgcgcgagaaattgggagatgtcgagactgagcgtacaagtatctccaaggagctggcatctctcaagaacaaggagcggaaacaccaatggtacgaaaagaggaaaaaggttcagcaacacaacgagaacggagagacgccgtccgagcaggatgatcgagcagcagaggcggatgaggaggctgagaccgacacgaccgtggatcccgagggtgatgcaagccaaaggtctttgagtagcaaatcacaagctgctgctgccattgcagttttgcagcaggcggctcagcagcaggcagctcagcaaacatcggcacctgcttctaaatccactgcagcgtcggccgcaacaaaaaccacgtcgtcaagggtccttaaacaagaagcagctcgggcatcattacccacatccacgacaacgacactgccgatcccaacaaccgcactattggtacctatggatgctgcaaaggcggtagggattgctccggtagtgcaaactgacgcgaaggcgacaacaccgcgagcccggaaacgtaaggacattttccgaacgagtgagtacagtccaggattgaagagttaggtgcctcagcatcgtccgttgtaggtccggatgcgatgttcccggtctcgtttgccgactatcaggatatattttaatttctccttcccccgacctggcataagaggacacacgcactcactcgcccagtcactcactcactcgcccagtcactcactcacccacccttccactcactcacagcatctccactcatcatactccgaatgcaatctatcttttgtatgctgtaaaaatgttgaaaaagaatgaaagctcacctctcagcgttataaatgccctgatggtgtgctgaggggtgggcgtgtgtcgctgaaaagggccacaagacacgatcgtcgcaagcagcagctttgagaccgtcgtgttggtgttggggagtatggaaccagacagaggtgaaactggggagtagaaggagtaatgtgatgaaaatttgccaggagaggaagagagatcttcgccagaggagcgtccgtgtctgatatcagtgggcgcgagcgtgggatcgagctcgcaattgtgaaaaaaaaaataccgtgagcaaacgggagagagggagcgagcacgatgcacatgatttgctagtcgctcactatgcgtttctaagagtttttgcgcgttgtgccactgagcgccgcagagtcggggccttgtccctgtcccgcacacgcctggtggtcgcttttccgtgtgtgcgtgcctaaatcagcttgtcagcataattgcagggcgaatctcctggggtactctaaagccaactttgtttacgtttttttattgttgtttttcaggcacagactgcacacgctttcaccgacgggctttgtgtcagaatcgcagcaaagacattcccatagactatctggcttatctctgtcggttgaagcagtcgacctgtgcttcttttttttttctttccttcttctcttcctctttcttgtttcgttcttttcaccttctccaacccttctcgccctttcttacatttcccaccatggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctgtaagtctcctttttttttacttttctacttttgacaacccaaggaactttttttttttttttttatctcggatcggaaatttcgtggggagaaaaaagagaaaaaaaaatcgattgacaaaaaggaaaagcgtccccggaccccggttgggtttcaaaacaaaaagaagcgagaagagagaaaatggtgggcaaaggcgtgtttagaaagggacgggaaagagtctgtcaacatacacttgagcggctcgcgatctcggatcagtcaaaccccacctccaacttgaagccgtccaaaaaaaaagtcgcccttctcaacagacattaaatcgttggtcagggcgaaggagggggaaaaaacaatgggtgtttctgtatttcttcgttttttgccttcgtttcgcgacgatgtaggaagacgcagcaggactcgaccagcaaaggaatgggcagtgcttctcccgctcgcgctccctgcacccactgagccaatcccattgatccagcacaactcagttgctggaagcacaaagcggatcattgacacctgaaaaaaaaaaagcacggcaagaggacaaagttgtggcgcatccgtcctgtgacggatcctatcgctctctcttggataagcactgcataggatcggaacacttgtgttccacttcactttttttttgttacctgtgcaagaagctgcatgcgagggagaggaggggagggacaggcgaggtggatgcatggaaacagctgaaaaaaaaagagacaagcgtgctaaaaaagacacagactgatttgcatgaacatactcaagatacgtgctttggaatgtgataactcatgtcttttttttccctccccctcttgtgttgtatgaactcgtttgttgtcaccgctagatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaaggtaacgcctccccccccctctctcacccagccactttgagcagtgccacccaccgcctgcttcatcctcgttcaacaacattcactaatgtcaagtctctcctcttttttgcctttgctcgtatttgctagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaaacaaaacaaacaaacaaactctgaggctcctgttcagcagaagtgctgctttcgagcgcggagcagctggagatggaagaaagaaagcacattgaataaaaaaattaaaaaaaaaaggtttgttcatgttgtgtttgaacgatgggtgcattatgaaggatcaagtggatatattacatgagaggaaagggcgttctggtgaaggaaagggggactcagtaattgtagacaaagtccaagcgatcgtcgcccacatctgtagtcgtctcatcatactgcttccagtcctgggcggtccagtcccgggtgatcttggcgcgtttgtcattaatgtaccggaggtggaaccgttgaaagatgaacagcgagatggtgatgagcaaggacccgaacaggatccacatcccagtgatgaatcgtggcgcgtgctgggcgcgaaagacgttgctgccggcgatggcggtgatgtttaccgagatgatatacatagccagtgcaatcgtccgcttgccgacaggcgccgtatttccagcgatccaggcagcctataaagaagcgaaagagaaagagatgagttcctcatgtaatagatccttgagaccactgcacaaacaccgttttcatttcgaggaaatccagggctgctttacattgacggggtgccagcaggtctgtgcgcccatggtgaagatcaggcaaatgtacaggctgtacttgctggcgtccagaggcaacagtgccagggccaggacgcagatagcatagtacagcgtggcaaatgcgccatggtaggctcgctcgttgaagcgatcggacgagtacgagaccgtggacatgatgatcaagctgaggaggtagcccggaatgatcatcaagttggccttcagaccatcgaacccaagcattttgaggatcaggggcgcaaaactgccgatgggggtcgagggcagcaatccaaagaagccaatcaggatgttgggccagatccggggcgaggtcactgcacgccagatgtcggctttggggacgacgcgtttggctggatcagccttggaggggtcatcgcgaatcagacgcgtgatggcaatgagttcctgtcgctcggtgaggtacccagagaagcgaaggtagcctttggtggcggtgggaccttccggtaggatgaagaaggacaggacgccgatcatcgaggtagcgaggccctcgagcaaaaagagccacttccatcctgctagtccagccaagccgcgcatgtgcaggatgccgtaggcaagaactccggcgcaggagttggcgatggacagggttgaccaaaagacggagagtcgcagcgccatttcttcgcgcttgtagtaggtggtgaggtagatggcgatcccggggatgtacccggcttcgaagagcccgaccaaggcgcggcagataaagtaagagaccttgtccttcagaaagacctgggcagctgtggccaggccccagaagaccatcaggaaggggatccagcggtgagggccgacacgacggatgatcatgttggaggggatttcaaagaagcaaaagaagaggatgaagacagtggtcccgagcgtgatcgtgttgaggtcaatgttgagatctgccatgaggttgtccgtcaaagcgttcgacatgttgccgcggtccagctgcagaaagaagactgtagagtgaaagggatgagaagatgttgcgcagagtctataggtttaagtgcaaggcctcaagttacacacttacacatgacgccgatccacgataggaccttcaagtcgaatatccgcacgagttgcttctcttcctctgcagtccatgtcagctcatggtcatagtgtgggttctgctcgccgaggactctcagtttctcatcggctgggtcggcgctgagggtagacgctgcacttgagctgcctgaggcggtcttttcaaggtcgcctttgtgttttgcatcggacagttcctgcttctcggacatggcgggtgggtcaatagagcgctggggtaaacggtggtgaggtagaggtggaggtggaggtggagctggaggtaggggcagaagtggaggtggaggtaaagatagaggtaaaggccgaggtgaaggcagaggtgggaaagaggttgaggtcgagccagggtacttgaggggtagctgagaaaatagaagctcagtgtgcaactaacaggagatctgtttgcttttatactttacgcaagatgcaaagtgtcagagtccagcgccaagagaggggggcctttgaagcagagaagaattaggtagagggggtagagacaggagcttttggcaaagttgcgttgtgggtgagaacaagattctttcacagatagctctgcaaagagtgatatggcgaatctggatgatgtgatgtgcttatgcagctcaagcaagcagaccaatctgtacgccccgttggcctccatgatgcgctagaacccacttgcgtatcgggcaaagaatatccgacagggcgcactaaggttgctaaggatgtggcctgctagactgccatctgaccatcacaacgtgtgtagaaaaatgaagcggccgcgtttgtgtaacaggcgccgagatgttgcaatttgctacaaaatgcgcgtcttttttagctggcctctaccgaaaaacctagtttgaagtcctgtaggcgagtgtcgccatccccttgctgatccttatcatcgagcggataaagacacgatgtcaacaggaaatggtctcgcagtcaactgagggtcaacagcacgaccctcatctaccgcttactgcccgtttttgataagtagagacgttgagcgctattcaggaacgtgccttgtagcgaaatgagccgcgacagcagtacatgacgatgttaagcatacgccaggcgagcgcgccattgtcttttcttgcctttactttccactgagggcagttgacgccaccgtttgagcaaccatgtccgtactttgctctgaccctagttcatccagacgcactttagccttaccgcaaaccttctatgatttgttttgcgtaaagaaacaacactcaagttctgagaaggtaatttcaaggggtggggggggggggggggggaggggggggggaactctggcctgttacctaccattaaacaaatggattagccgtgtatctcagtcatgtcgccattgtcggatgatggagctgtccttgtggctcaatcgcctgcttcttttgcagaaaagacgcggtccattagatcaaagccggggtgagcttcctcatggcatcatgtcgcatgtgctttgacccttcgtctacgcgcgcctgccaaatgttcccgcgcgttttttttcatccctgtcgtccgaaccaatcccgtggcgggttggaaggcgagctttgccgactcgacttcacacgcgagatcaacggagtgtcgcttgccgagtcctagtagattcttgaacacttgaatgaccttattgccaagcgcttggactaccaggttcgcttccgctgggagaagcatagtatggcgatctgggacgattggtgcacgagctacgcgattgtggctgattataagccttacagccgccaccggtcgagggtcaagggatcgggcgacaaggccgactgtaatcctaagagtagccacgcaagccaaggcgtgggaggcgactgcgaacatgaatgcggctaagcaagtggtagcagtcgaggtagcagcccacgacgttgacgcgacagctgccagaactgcatagactgcccaaaaatttccaggtgacgtgtggcgcgcggcgccccttgttgctctcctcatctcttggccgcattcgcttttgcagatctctttgacgcgacatcatcctttggacactcaagacacacaggacagcacggccatcagcatccacatccactggacacactaatcccatcatcacaactcacacccacacactcgcacacacacgcacatagccagccatgagccacaactcggtcgagcctgatgacttcctgtcgcctgcagcgcccagctacgtcgaggcatcctactcggacacatacgacaaccccttcgagaccaacatcccccagcgggccaactcgccgtccatcgagcccgatgacgtgcccctgcctggacagaagcccctcacccctgtgaagagcccgctgcccaaggtctctggctccatcggctccagcagcaatgctgccaccagcagcagcaacagcggcgtcaccagcggcaacattggaagcagcacgggtcttggcgtgggccaggctaggatgggaggcgacattgataccctggacgaacccgtctctgaaactcttgtatgtgttctcttttgttgggcatttctggtcgtgttcagcattcaagagcaggatttcacattctcttggcgctacagacagtggacgtccataactgagtttaacttctggtcgctgtatatcatagctccgagatctgcgtaatgttggagccaagttgcagcaggtgctataccccaagggacgcaaggatatcctcaaagactgtacgtgttcatacgaggatgctatcgatgcgcggaaacgaggcgaatgatggcactaatactgccacacctgggatatcgtattctaattcgctatcataggggatctttggggcccgcttctgatgtgcctgacattgtccatgtaagtctctgggtgtagcgaatggtttggtgattctgtcgaggcaagtgttctatgaattctgacacgatatctctttttttccctcgcctctagtgtgttgagcacaagggcgcaagcggatcaaaagattacagtcttcacttggatctttatcattgtctggttgggatcggctgtcgtcacagtcaacgccaagcttctcggaggaagagtgtaaaggatttgctttgcaccaggagaatacaaaaatcgaacgtgtgttgcgatggagagctctactgacacttttccctttttcgtcgtgttccatgctactctataggtcttttttccagagcgtctgtgtcattggatattgtcttttcccactagtactggtcagcgtggcgacgattgtggtgcccagcatctacatccgacttccactgtgcggagttgcgtttgcgtgggccacctgggcatcgattgggttcctgtcagactccaatctggccaacagacgcgcgctgggtgtgtacccactattcttgttttatttcatcattgcctggatgattctcatttcataacggcaatgccgtgaacaagcgtcgaggagagtgggatgcaaagcgaaaagtcaagattcaaactatggcactaagaacgacagaagttcagcgtatttttctggagtctggtatcgcgacagaggcttgtctctttcattcatagtgtccatcaccaggaaacaataaaaagtcttcgacacaccttggcgtcgtctgattagagccgtttatggcgaggtcgtcttttgaacaacattagcaaccagttcagggaacgttgtgtctcgtatgaagtgtcctcgatttggaagttcaatgtaattgactccgggaattttgctggcgacttgtctctgctcctcaattggtaccaagttgtcagtcgggctggctatcgacgagtgacaaggaggcatttagcctccagggttagttcacgatgtaagaatgtaatttttggtactttactaggtgataaaatgaagtttgagcgtaccaaattggatgatccagctagtgtttctttcgatggcgtcccagttccaggggcgattgaaatagccagactctctctactccgaaccacataacaaagaattgtcgtcagttgaagggccttctggaattaacgccgctaccacagcagtgaaacgctccttgcctcggatggatcgccgaggtcagagtgataggcactgactaggacgacgcccttgaccttcctagactcgacgtatcgcatgatggcggcagcaccagtgctgtgtccaatgacgacgtccttctctccaatttctatatcgtcctccatgaatcggatccagttctcttcgtgagcatcgtatgggtctgggaacgtgcgcaggacgcctcctcctgggaacaatagctggcccgtggcaggatccttggccgctgcgagagtgtcgatagcggacggataccacattgagttctcggcattgtcgtttccgttgcctggaatgaggataatacgggacatgtcgactgcaatggcgtctaatgtgctgctatgtgtgtgagagagtgagagtgtgtgcgagtgtgctgtaaggtgtgtgtgtgtgtgtgtgtgggcgggggtgagaaataggcgagagtgtcagcagaacaggtgaacgcgtcgcgcacccgtggcgatggcgatggcccttaagtgcacattgttttctgcaaaccgagcgcctcttgttgatcgtgttgatcccattcacttcccaacaacccctgctccagtctctcgctgctctcccatcggtccttgctatccttccctgccacattctcctccaggccgcgtgcatcccctgttcccgtccatcctgcaggatccagctgcgacccatcaaccctcccgatctggacacaggcacgctcaccttctgtggaagagactcgctctttaatccgtaagtggcgcccgttgttggacttgcgcgaggcgctccattcagaacacattaacacttgaaaaagcgcgacctctaatccttcgctcgttcgacaggaccccgcacacgccatggagccgcagtggacgcccacgttcgaggagcttgccagaaatgtccagagtgcgctgcgatcagattcacacgacttggtctacagcgtcctgcgcgaattagaccttcacaaacccgccatccacgcagtgctcgaggcacccggccccaatgccgcccatagagcccagctgaagctcggtatgtctactcgagtgcatgatgcccatggatctcacgctgtcttggtcctgttgtaatgcttcaaggcatcagtaactcactcagggggtttttttttcgttctttatctaatgccttctgacgtgcggctttggcatcgataggctcacctgtgatcggaggcaaagtacggaccgtcaacgagcagtttattgtggatgcgattctcttatcggaccagctcgacatggatgagtacgcggcggcgtcgcttcttcagcacggcttacagcaccaggctcgtttcgatcgtagtgcagtggagacagccatccttctgttccaccgcgaaagaattgcctcgttgatcgccatctatgcgctgctggacacatcgaccacgttcgactcccctacagagttcagcaaggcaatagtgcctttcaggaacgagcttctggatccagcaaaaggcaatcttgccagcaaagctcttgctttgatcgaaagcctggaaaagaaggcgactacactcaaaagctccatgtcagagacctcggccctggttgcgcaacttggcatgtccatcaacgaggaccgtctggactacttgaagcaggagcgcgctttggtggcaacaatcctcttcgcgatcgccttctaccatgagctatcgagcgctgttgtcaaatcgaccatttctgctttgaaaaagctgacgctctctgaccctatcactacatatctcaccatcactgtcatggcggcgtttgaggtctctgcagagcaccagcgacttcgcggaaaggacgaagaatcgttcccaggttacattgtcagcgagtccttcatcacagagtacgcaccatttatcaccgagaccaactgggctgtccccgccattcgcaacacaatcctgtaccagttcagcttatgtatcggcaacaccctcaacaaccgctcggacgggatgactgaggacgacttgcagattgttatggagaaggctgtggcatcggacgcgttccagttcatcgccaactacattcttggattcaagtcccaggtcgtgatctctggagagcagttcgaggtccctttcgatatcccgaacgcgtctctgggcattactgatcagaatacggatggtttcgatacgacagtggggaagccggtcgtggtaccactagactctagtatgcaggatggtatcctcgcaatgcttgagctgtcaatcaaagacttcatcatctccatgctccctctactccgcaagatcaagcacaaggaggaagatgccgccgtccatcagacttctcttcgacaatcgcagtctcagtccgtggccaagcctaggaacgatctcgaggcgcttttcaccgtcattgcactcgtgtacaaggatcgtcctgaggctggtcttcgcttctggcccaacaatgacgatcgcctctatcgcttcctcaagtggggcgtcgactgcaaaaacaccgcccgggcgttctttgagatgcttggatctctcgctacaggaagccagtgcgccaatgcagcttacgagttcttgaagagcaatggagggcgctatggaactcaaagcacagcaactgtccacactctgtgctcttggagcaaattgtttgaggcgattgagttttacaccaacagactgaatgcggatcaggcagcagggagacagctggaaaagattcgaccggaggaagaggcgcttctaaagtcctttctgcgcctgctgtccacggtcgcccagtattcggccgttgcgcgtgtcgccatgaatgactccaagcagttccaggtcatccacgttttattccgcttcctcatttgccccatcgccgtcgacttgaaggccaacatcctggacgccatcgccgcgtttgcgacacccacaggcgccaccaacgattctgccagtcttgtttgggagtatttggaacaagccaggatattgccaaaggcctacagtgcctcgttgcctgatcaacttgtgcaagcaggcgataaggctacgactgcagcatcagcccgtcaggagcatgagaatctggattcaggaatcggcttcgatatcgaggagatcgaggctgccaacgagacttttcccgagaccatcgcctttgcgcgccttttaagcagcctcgtgcaggttcctctgaatcccgaagagctgctctctggcggttctccgacaatcccttctggtttgggatccaactaccgccagcccggcgtcattccttatgtacgctttgtcctggacgtaatctttgtcaaagctttgaaccgctcatatcgcgttgccagtgagaagtggaaggttcttgacgcttgtctgaactttatggagcgatgcctgttgtctttcgatatcggttcgttcatcttgggcgactctcgcaggaaggagcaggacagcacagcggtggatgcacaaagaaacagcgctatccgggcttcgcttcatcccgcctttgagattctcacaagactcttgtcgggtggagatgttcttcggacgattttccaggtcgttggaacgggtgtggatgttctcaacaaggatgacctgaacatcccgcatctcaagtcctccgtcaccagatgcttccggatcatgacaaagacaatgcagcttcaggatgtctttatggaatacattgttcaggtcctgctcgccaccaccaccaggagctctgtcctctcctccttggcgcccatggagcagcacctagcctacagtcacacgactatcgtcgacattgcatgctatatcaactgtgaggtcagcaacgagatctgctctttggccatagaaattcttgatcacctctctgcatcagcccttttcaccagcggagagagccacaggggcgtggtcaccaaccgactggttcgccttttggaatcatcgcctcggtcaaaccagatcctgtacggatttgtgcaaaagctggagacggaggacgatgagctcacgacagagtttggcgcatctcagaccaacaccttaatggcaatcgatgaaccagatacacgcaggacatcacagaagaatgctattctcgctgcaccagcgattacgggatcgaccatccgccttcagattatgcggctgttgctagacaatctggacgagagccgcggcacaccctcgatcgcccatttcttgctgggataccccacagtgtccaagattacaggacccgagcgaggtgatacgctctcgagcttgacgtcagttacatgtctccacgtcaccttggatttgctgcgacgaggcttggatgttcaaggactcgacatcaacacagcttcagctaaaccgctctacgtcacccatcctcagcttgccgaaaagtgccagcatctcgtgtacaagctatgctccgagccagagacaacatcaccaaccatgcgttacctccgcacacgagaggctttcttctatagacatctgcgcgcacttccgacacgctttgaagaaggccttgcgggcaaccacggcacctttacccgtgtagacgggtcccacttccgcgccaatttcttcaacctcttgttccagctctatcagcgatcctgggtgatgcgcacgtcggctttggagcttcgcgccgcttgtgatacgaagcagcgccgtgaggccgagagcctgctttcgctcctttacagcaacacggacaatgcccggacaaccaatggggacgagtttatgtactcgctttcgagggacaacaacggcaacttggtacaaccacggatgaagattcttgagctcttggattcgctggacttttcctgggaggatgatctggtcgtgagagatcttgagcagcgccattttttcgcagaaatttcggaggagacctgcctcgagaaggacgagtatggcgtggaactgtacaacgtgcgcaaaatcttttcactgttgatggctcgcaaggcacagctggagagcgagaatgcaattgcagcctcggataggaggacgatcgcacacgccgagatggaggcaatcatggagcaatgtttggcccggaatcacgccaggaaaatggaagctggacggcggacgatgtttgaggcgtggcgtgaacttgtcgagatcactctgggcccaggctttggctccctcaaggtggagcaacgtgaggtgatgctgctggatgttctggaggccgttctggccaagttgcaaggcgactgccctgcggacattgccgccattctgagcaaggtcgctctttgcgtccttcagcgtctgcgcttggatcacttttgccaattcattttccaagcgacctcgaccgaccccaatgagatcaacgcacgactccctgctgagcgcctgcaccgcgttgcgcaagacatcattgcttgcatccttcgacccagcacctcacgatcgcgatgcaacctgtactcgaccttggtcaactatttccagtacactcgttcggagggtgacacagtccggagtgctcacgcgactggccagtccactaatggccatattgccgacggcgccagcagtcaagaggaccgtgatgttcgtttggcgctggagctcgggaaccaagtgctagtcgcggaggcaggcgaccggttgtttgaggtgatttgcaaggatgcctcggacgttgatgaagtgtgcaagatttcagcctttacactgctgaacacactttatgggctctttgagaaggaaaagaccaacagggtgttgatgcatcttgttcagcgtaactacctcaagcactttattgagatcatggccagggaggatctggagctgcaggcgagcgtgaagggtcgtatgagcagggtacctatcgttagcgagacgcgtcttaccttgttcctgcgcattgctcagcgacgggatggagccgagcagttgctcgagtatggctactttgatgtgctgaccaactcttcgacagtcattgacatgcggtcaaacctcgacactactggtaagtgacattttggatctgtatttatgttgttgaaggttcatcctggaagatagaatgctcacagtgcttgttaatgtttttttcttggatgctgtagattatggtccgtttgagcagacagagggcagtcggtaccacaacattgtatatcccatgcttcaggccgctgtcgccatcttggccagtcttggtcggaatcatcgcactgcgactcgcaaggtaagctggttgaataggccttattatctcatccaaactctgaaaaacagcttcaagtgcttatgaatttgaaattgttatttatgaattgttaggccgaggcatttgtgaccagccatcaagacaccatcacgtctattctccgcgacaacgactttcctaccacgatcagctcactccgtgaacttcgtgttgtcacggcgttcctgaaccagcttgctggtcatattgcctcacagtcaacggtaaggtgcattgatgaaggtttcagttacaaatatcgacgcactgaagtctcgtatactgataaaaaaaatggactttgtgcttttttccttgttggtggacgatgatagtctgcagcgtctgttttcgggtcgctgcatggactgctactggctctgattcccaaatacttttcagcggacgaatgggcgcagtcgttgcgtccagtgacggatgccgagttggtgatgcagagcactttagcgccgtcgttgacggctaggaaggggacgacgctctttgagcgcgatgcacgtggtctttctcgcgacatttgcaagaatctgctgtcgtactgccagaccagcacggacattgctgatcgctcaggtatgtttgtgagacgtagaaacggaagcccatgagtggacgtttttgcgtagatatgaatgttctgattgtttctaactgtttttattttattattgatgtcccttttcatagcaggcaagtcgttcacgcctctgtttacatggatgctgtcgaatgtcaagactgggcatgagctgccgtcgttgtctacgctggccagttatttgggccgcgtagcgaatgaggtgcaggaggggcttcagcggcgtcagacacagctgctgaagctgaagcatatctcgtcgctgacgcctgaggagaagcaggatattctcatggcttcggatgaggacttcgtggatgatttgattgcgatccaacgtgaccagctggcggttcaggttctgcaaaagatgctcatgacagctacgcaggaggtgctgtcttctctgtgtaagtttgaggttgtgcttttatgagaactgcgcgcttttgatcgtatgtttgtatgatttccgggttgactaaacatttcattttttgattttgtgtttgggtatgacgatctacacagatctgttggagactgcgttggtgttgttctggagacatctggactattacttgggacagtaccctggacagctggatggcccaggcgcacaagctggacagggatcatcgcggtttggattcagcgttggcctgagtagcttcggaggcggcaatggcacggtatcgttgggatcaggagcaggtgcgggcgcgagcagcagttttggcgcgtcgggcgcgaagaacgcgagcttgaatgtgagtcagggtccattgtccaagaactttaagccgacgctggaggatgccaaggcgatgaagcgcgatgcgagtcatttcatcaagcccattctggacagcattcagggacttgatcttgtaagtgtgtctgtctctcgctctctctctctattgatggacgctgacgtctgtaatgctttacttgtattttccgaagtactggaaattaacgcttgttttttctttttattgttgttaataggcgcaagagcggatcggatgggacaacagtgcgcggaacagctttattgagttgctgacacagcgcatccgcgcgcttgtcgagcgcaattgaggaaacaaggaaaacgacgcatatgcggaagaagattgcagaagtgatagagatacgaggactaggggtgtcaattcagtcgtaaagaaaaaaaaacaactacaacaacattgcatgtacacatacaaagtgtgttgatgatggtgatagtgagaggagagggcaagcagacgcgaaacaaataggatcaagggcgcggaaggccaggagaaagaggcaaggacaagagaaagaaggaagaaaagaggaggaggggcattcaaggggaggagcgaggatccctggggatgcttgcgaatcgcgtgccagtggatgcagagcaggcagacagagcagagcagacagatggagcagacagagacagagacagagacagagacagagacagagcagacagagcagacagagaagacagatgctggtttctccccagagatgtttcgcctttgggtctttgggtctttgccacagcggtgtctggttcccgccgaaaaaaggagtccagggacaagggacaggttgatagtgtacaacacatagatggcctttgcagcccagctgtgcgtgtttcggtgcggcaggctaggacaggatgggtgctgggtgtcgtccgttgatgaggagcgtctgttctatgccatgctgtatgtatgtatgtatgtatgtatgtatgtggtgtctgcagcatgcattgcacaacgacaatgctattgtatctctctgtcttctcctgacgctgttgtcgcgctccttttttttttgtatcatccctattagcacttcttttcctctttttcctctttttccctcgttttccctctttttacctctctttcctcttcctcgctctctctcgctcgctccagtcccgcccctctgctctcctgtggcgtgtgtgctctgtccatcgaggctgcagccccattcccctgcttgccatccgccgcatccttgctcccactcgctccatccacacccgccagcaccagcacctgtgtccatggcgaccaccttcctccgcaagcgcgccttgtccttctccgaggacgaggacgacgcatcgcacggtaagctactctccttctgtctctctctctctgtctctctctctgcctctctctctgtctctctctctctccttctctctccccacgtcctctctccctatcgcagagcacaagtgctttatggactgacacacacaggagtatccccttctgcaaacaacaaaatatacaatgtctagtctatcccccgaccccgaccaagcgcatgtcgggcgcagggttctttcatcagctgcagacagacactcggcccgtcgcaccccccaacctcagcaacgcgcttgctgacgacgacgacgatgacggcgacaacagcagcagcaaaggagacacggctggggagaccgacaccagggctcagagacaggatctggaactgctcgccaaggcggcgtcgtcgtcactgccgacaccagcagccaaaatcagtcgagcgaccgccgcgatcacgccaccgcgcactcccacgcgtccaaggattcgccagcagcagcatcaggagacgggcagcgcagagaacaaggcccctgcggttgagcgcgaacgcacacagaaaaagactactggaagcctgctcactcccaaaacaccctccaagtcgtctgcaggtggcgcaggcctgtcaacctcggacgcggttctgaagcagaggagccagcagagtacggggttgacgcctgtaatgaacaagatctttcggcttacagacggtaagggtggaaaatccatgggtcatgcccacgggagtggactgtgaagggtgtacccccccgttgcgaaagaacaatgatggctgatccttttccgtgctcttctcacgaatgatagaaaattcagccggcgcgcccaaggtgaagggaaagaaggtgcaggacgagaatgcgcccgcgccaggatacgcgacgccaaagcgcctccaacggcaaaaagcacaacagagcgcggccactgacacgatcttggcggctgcccctgcgaaaggagcacctctggctggcgagagcgctgtcattcccaaagccagcagctcggccagccccatgttgaccgtgttcagatactatcaggatgccaagactctgttcagacggaccgcacaacctcacaggctggttgggcgtgagatggagcgagaggagattcgaaatttctgtcgagaacacatcttgaaacccaatgcgggatcgctctatatctctggacaacctggcacgggcaagacggcgcttttgaacgagatcctgcaagatatggagcctgagctggaagaagcaaagcacaagatcaagatagtggtgatcaactgcatgaccattaaggacccgcgactcgtctacagcaagctgcttgaagagatgggcaccgcggtcgagtccaaggacaaggattggctgatcaagacgctggagtccatggttctcaagtccactaagaagatcatgtagtaagtgattacttgaaatgtgtgagccttgtggtcaggagcttagcaaaaaaaaggatgaggttatctgacgcttttggttttggtctggcgttttttagcgtggtggtcctggacgagattgaccagcttctgaccaaggaccaggatgtgctttacaagctgtttgagtggtcgtccatggagcggtccaagctcacgttgattggcattgccaacgcgctcgacatgacggaccggttccttcctcgactcaaggccaagaactgtgagccccagctcctgaacttcaacccgtaccaggtggccgagatccggagcatcatcttggaccgcctcttttccttggagggtgagaagagtcagggcaaaggcgacgagaaggatgaggtgactggtaaacctcgagtggcaccgctcatgcagcgcccggccatcgaactctgtgcgcgcaaggtcgcgtcggcgacgggtgatctcagaaaggcgcttgatatctgccgccaaaccattgagatggtagagatggagaccaagaagaaggagcgttcagagaagagcccgcagagtgtgctcgcacccttgagcaagagccggctcgccagcctcgagaaccagactgcaggcggtgtcgatcccgcaacccttttgcgccggacttcttccagttcttcgagtgactcggcgtcggtggcaccgtcgtctcgcgtgttgggcggagcggaaggtgtggcactacaggaggctcccaaggtgacggtggagcacgtgaagagggcgctggcgtccgctttcggttcaccgctggttcaaaagatgaaggcgttgaatctacaccagaagattgtattggcggtgttggtggtcaagatccagagcggcaagacggtggattgtgaggtggggaaggtgtttgaccattatatggtgatgtgccgatcgagcaacaagatcggacccgtgaaccgaggcgagtaccaggatttgatcaatattctggaggccagtggattgatcacgctgacgatgagcaagaagggtcaggaggagaggctgcgcaagattggattggtgcctcgggagggtgaggtgctggaggccatcaagggacaggatatcctcgataccatcctcctcaaggccggtggtgtgaaggcggacctttagaaacgacctgcctctcatgcacgctgttgagcgttatcgtggccgcgtcttttggatggccgaagggctttcgagccaccacagagtttgtcgtcgttgttcgactatagttttttggcttctttttttttttggtatcgttttgcttgctcagggcgcgaaactggcatgtcttgacttcttctttcgcactgagcataacgcgaccttgtctataccctccttcccacacctacactcttctccactcatctgtacatccgtctctatatctcgtcgcatgctaccaaagatctataaaaaaatatgaaaaaatcggtctagggggctgatccgacggaccgtgaacggcatgtgtcaatgtaggcctcacgaatgcattgaccatcctcttgcatatcttacccgcagcgagcgttagaaaaagaaaagaagtcgggcaaggacacctgttcattccgagaatggtgtgcttcgagactcatggtacgggaaagtaatggtctttttattgcctgacccgcaaaacggacggtaggatctagaaaaaacgaagaatgagttcccctgatcagggtgctactctttgtcgggtccttttttatggcgggttagttctctggcaagtgtccttgctcaagcgggaccattgcggccatttgtttgacatgtgttgtatcatggtaggatgattgcattaagcgggaacagctcagtgggaagaaaagagtgagtggggggtcgatgggctagagggcgaacacatggtgctggagggtcattgggctgtaacgttcttggtgttttcagctgaaaaaattattgtaccagttcagtgtgagaggtgtgaacgtgcgcttggcatgggtttgcgctgtgaccctgggccgtttgctagtgcatgctgaaggagggggagggaggaggggcattgggcatgctgccgtgcaaccgtaccgctggactgactgggatgcgggggaagcagaggagccagtttctgggaagcccgagcgggtgtccagtcgcgtgttttgatcttgggttgctgtcatgagcagcgagctgcttggaggaggcagaggaagacaagataggacaagatgaataacaaaaaaaaaaaaggtccggctctcgtcggatgctctcatcccatggtcgatgtgctcgcacactataattattgtcaggacaattgctcatgacagcgaggctgcttacacaacaaacacacacacacacacgcacacacacacacatggaaagtgacaggcagtgagggtggcgaggcacatgcaggccgaagggcctgttgttcttattctggagtcttgcccacaacgttgcatgtgccagtcgacgccatcccctgttccgccctttgcccctgtgcttccgtgtctgcgtgggtgtgcgcactcactcctcactcctcactcctcactcctcattcctcacttctcgcacactcagacctctttgtcctcactctcactctctcactctcactctcactttctctctcactctctcactcgcactcgcactctgcttcacccttttcctcgctcttgtggtcttgctctcatcacggcccttttttcctctccttcgcttccatcggtcctctcgcgcatccagattcatttgagtctttgtctcattgtcttggccacatccacttgttctctgcattcgcacgtcccttccagtcgcagcatacacacgcaacttcgtttttgtcatcgttgtattcacacgcacacacacacttcttggcggacaatacgacagacaacgaaactgcatgcccccgaggccattcccttgacagcaccaaacacgaggcactgacaaattcttcaggcacacagacacttatccttcaatcctgtccaaccccactttcgccatggggtcaacaatcgctgaggcagccgcgaccatggtatcgccgcccgtcagtcccctcccgaatactaacgacggcagcttcagtcctgcttcaccccaaccgttctcgctctcgccctccccaaaaatgaacactatcccgcagaacgcgcaccaggcggcccacacggctagtccctcggagacacagatgatggcctcactggacgctgtcctctccaacaagaccacagcggcctcacccacagaagccacctctgattactacagcagcagcctagggggcggaagcgacaatggtcacgacgaaaacgtatcagacggccataacctgcggtccacgacagacgctgcgccagctcaaaatgcaccgcctacgctccagcagatgggcctcgatggtctggacgatctggagctccgtatgctgctccagaacgcttatgaggtcatccaggaaaaagaccgcggtacgttcctatttctcactgcactatctcgcatggtttttcttgttttctcttcattctgtctttggcataaatgtgcatattggcataatccgaccaaagagtcgaaagcggcacgtcctcgctggttagcaagttgtatcacacctttacctcttccgtgattctttctttgccgccctcccttccggtccaccccttgcccttcttccgagtcgtggcctcttgttttcctcttatcgatctcttagcacgatatacatcgcttttttgcccactactgtctctttacaaccccactattcgtcttgtgtgcgcgcacaaatcatctaactcgaatcttacatacgcacactataacaacaacccccacagatctggacatggccgctatgatgggccaaggcctcgtcgaaaccaaccatagcttgcaagcgaaataccagagcattctgacacagcttcgacagcaacggttacatcgtccgcgtcagctcacgccacccaagaccatcatcctctctcccccgccagaactgactggtggagcgatcgatgcagaggatggagacgacaactgggtcgactttgaacccaacccatcgacgttgcactcgtcctcgcaccatgctcatggctctggcggccccacgggttcctcacatcaccatgtgtccttccgtcgaagtggcggtggtccgggcggcaatgccatcctgcgctcgcggtctcgacaggatgtggagaagatggccacgttggaggatctcaacacggagctccagaccaaagtggatgcgatcactaaggagctgaagcaaggtcgccgacaggcgttcaagcgtcatcgcaaagcagaactggagctcaagatgatcaaggacgagttggaacggacgacccttaaggtggtggatctggaggaacaaaacggacgactgattgaggcgagccgcatgattcgaatgcgacggatcttgctcaagaaccaactgcccgcaccgggctccatccctggatcgaccatggccaacatggcggtggagatgcagggcgatgaagccacgatccaagagatgttggctgaagacaacaggatctttgaggagttgcgggaccggttgcaatcgctcgagcgcaagaacttggcgttggtacatcaaaagacggatgcggacaagaaggttcagcagttggcgcaggagctggcagaggtgcagaaggatcatgaagaactgatgacccagctgtgtgggtactcggatctccagacggcctataatgaacagtcggcccatgtgcgggaactggaaaactcgattcaggaactgcaaaacaccattagtaccatgtcctcgaggctctcgcagttgaactcgcccctcatgtcgccctcggaaccgtcgtcgccgatccagagtctgtggaggagggacgatgcggatttcaaggcgctcaagaccatcttgcatggatcgagccctcaacccgtgccattgaagtctcctggcttgaagggtcagcgtcgacctcggaggacgcttctggcagaacttgagagcgagtggttcagagacgtgtcgttctttggaccgcctcgggtggtgacggaccagacccttcacctgcctggaggagtgggtcacggccacggacccaagtcgcctaagcaactcaagaaccaccgccacgactcggagtcggaatcgttctcggatgacacgggcggacgggtcaagggctggcgcgaacgtattcatcaggacatggacgaggaatctgcgtgcgagtcctcgagctgtattcgcaaacgacgtaaccgattcaagtatgcgggcagcgacacggatggcggcgtgggcgcaggaacggtgggacatcccttgaatgacaacgatagcgatgtggagcgatatcgtctgcgtcagcgccggcgcaagagacgtgccactggatctggaggggatgatttcgaggatgatttcgacggtgaagatgacttgtcggactgctcggacccgcatcacctggacagccaaggcagaccctcgactccgggatgctgctgccatctgtatgatgagttctccgactacagctacgatgacgaggatatgatgtgtgacgatgaagagtccgtggtgggctgggcgcatttcgaggaccatgatgcgtcgtcgttcggatatgacaagtaccgggacggctactacatgggtcgcaagtcgcgcggaggaatcttgggcatgctccagagcgtgttcctgtttgtgcgcttggtcatgcgttggtgccgcttcattgggatcctgtcgacggccttggccattgccatctatcgtggacccgatgctctgttgacggatggacactaaagcgtgcacgtccatttttttcacttcttttcattctcaaaatgcatcatacactttcttttgataccacgcttttttgttccctttttctgtagccctatactttagcttttgccaccatgtcccaccccgactttttttttttcttctttttgtctcgctataccaaaacacaccctcccgtcttccaggtgttgatcctagtaatacctagaattccttggattgaacttttatgacaccccctctctcttcgtttccttccagcttacaacatcttctagtttttgaagactactataatgaccattcagaacctgaacaccacgctttttgttacttatcatcctttgctttatggtattatgtgcagtgtaaaattgatggcaaagaccagccctgctctcatccccccgttatttccctctctgacacgtttcgatcacttattgcgcctttttggtggaacgcttcttggatgacgaagactttgactttgtggcggtgctgttggcggaggcagtggtcgactcggtcgtggtggtggtggcagtcttcttgatggtgccatcggcgttcaagtgtgggtaggcagctgggtcgctcgagtagttggaaccgcccgagaagagcgagaacacggcaccggacatggaaccggcgatgatgtagatcatccagcgactagatcaatatgaaacgagggtgtgagttgattagcaaaaggaaaaaaaaaaaaaaaaaaaagtgtgatggaaaacaattaaacaaattcgcacgagaggaaagaaaaaaagagagattgatcacttacggcatccaggaggtgtactggcccacccactccatggcatctgcgtacatttcaaagtaaccggacctatgagcaaggaaaaaaaaaaagagaaaaggtcgatatggtcaataacatctcacaagtctcctgcactcccatgttacactacagtctttttcccttgaaatcaagaaacatgatggtaggttgacggcttacagagttgagtaagggcccatgaggccatccatgatggggtagtactggtactgttcctcctcaataaagttgatcaggaactgggtgttgttgcgctcataggggatctggcggaagactccatccttggcatagacgacataaggcagacgggcagggatgaagaaccgagccgagagacgagcattgtcctcgacccagacagcggcaaactttgtttgggtttcgttcttcatggtggttgcgacatcgaggtaggtggggtagtagtctgcgcaaggagtcgaggtcgtggagcagctacaaggaggaaagaatcgaataccaaaggaacggtgtgagtagcgtgccttttttttcaatattttttttttctccttctgctgtcgagaatgacccccccccccctcctccgcagctatcgtccatagcagaaaaacgagaaactgggtccaacttacaaggtaatgatccactcatcgtcaaagatcgtctccttgtagttggcgtctgtgatgttcgtgatagcaccctcagtatcggcagcgaacacaagttcgggcccaccacctccggtgataagggtcttgatgagctggatgtatcctgcaacgccccgtgcctcctcgacgactggcttcgggtcgtcccgtccgtactgtgcagtggcaggcgaggccaggagggcgagggctccgatgaccgccatggaggactttgtgaacttcatttagctgatgtggtatggcagggggtttttgttcttggttcctgaataacgagagggcgcgggctgttgagacttgagcgggtgatgcagacttggtgaaagtgaaagtaaagaaagaagagagaggaaagggcgaggaaggaaagggcaaaggaggaagagatggactgtacagaacgagaggacgagagatggtgctgatggcttcggcggtgtggtgtgcgtttgctttttttgcagccctccgatttgtgtttaaattctctcacaaaggcaacgttgctgcagtgcgcccattggtccaactctctttgtgttcactctctcggtccaggttcgacttgtacgatagagccttttcccaccaaaaaaaagtataaccatcgacttcgattcttcttcttcctcctcctcctcctcttgttcctgtacttctctcgcacagtcatgcgaggtagcacggcctgtggactatgttggccgagtcgttgtaaagagccttgaacatggcacatcctgcgacgaccctggctcgatctgttcctgatggcttttgcacgggcagagtaagcaacgaggccacatgtgtgctttgccctcgcgtgctcgaaggacatggaaagacaaagaaagaaaagttgcatgtgtgtccgttgcggtcttggccaatgggaatacgatccctgttgctcgaagggacatgagcaaaaataaagaaaaaaaaactctcaccgcaattgctctcggaagctgttggcgacaatcagcaggctacctctctctatgttgcatagactacagttatatcggctaattctcatcgaaccgtaaggaaggctgtggaagggcggcatccgccatgtgtagaggtgtgcgtgcgtgtacatgtacggtactgttccatatcgccatggatcgtttgattctttgatggaagcctattccggaagagttcaatgtctgtggccagtcgcccagatcctcaaactctcgctgtagcctcccacgcaaagaatcaagcctttgagcgatcgctgctttcagctccttggtctatgtgctttgtgctttgtggggttcttttggcgcatctgtgtcagatttggcctctgcagggcgtagcgcgtccccgcgcctgtgaccttgttttctcggcgctctcaagctctttaggaatctctctcctcttgacagaccacagcgaaccagcatgccactgcgtctctttgcattcggatccaatggaaacggccagcttgggatcgcatcggacgaggacacatgcacgccgcagcaggtacacctcatcgaccagccctgcctgccgacccatggtcgaaccccatttctcgcctttgcatctggagggaaccacacggcgctcatcactcgagacgaccagcgcctgttcatgactggctccaacaaagacaacgagtcgctccttcctgagcccacaaagatctttcgagtgcacacgatacctctacagcagcaccaacagcaacaacaacagtacccaccagagcgacgccgggagagacagcctcgatggcgatccgtcgcctgtggatgggcgttcacgatagctgttacagaacccgacatcgacactctacaccaagacgtctttgcctgggggtctggatcgtttggagaactcggtctgggaccaggattgaccaagactggacgtcgggccatggagatcgaaacgggattactggaccgagccacatggacgtctccggaccagtttcaaatccttcaagtcagagcaggtctccgacacgtcctcttgttggcaaaagaatcgacgcgatccagcagtggactctcaacacagacagtgttgatggcttggggcaacaatcgacaaggccagcttgggatcctggaacggccacagtcatcaaaggccacagctttggtcatgacggagaaggaacttcgtggcaaattcttggaacccatacgcgtcgttctcacgcgccagcaagcgaatgaagcaggggccaacgtcgatccgactgaagatccacaaccacagcagcagactttacccgagattctggacgtggcctgtggtcaaaaccactctctcgtactctttgcagatggaacggtgtatgcctcgggatgcaacaaatacggacagctaggtccaaatttgagcaggacagagcatcagccaagaccaaagttcagggttgggttcgagaaggttgaaggacttccttatgtggactcaatctcgtgtggttggaaccataatgcagccatggacacacggagaggagccgctgatggcagtggcgagaatgggtccttaaccaggatctatctgtggggcaggaacgatcatgggcaactaggagcgggaacggcagttcaaacgctgtcgttggatttgagtggcgatcagagcataccaccaaccgtcgtcgaggtgcggatacccaaagagagagctcagcatgcggatgcggacgcagggacatcatacgaagatattgtctctttcaggtgtggatcggagcacacattggccatgacccggtccggccattgctatgcctggggctggaacgagcacggaaattgcgggagcggcgagggagacgaccatgaggacctcaaggatgtaccagcaccacgcagagttcacttcccagtggcatgctgtcacaaagattcgacaaatgatccagagcatgggtgggtcaccggagggtatggttcctcgtgggtatggatcccaaccaaggcagcttcataaacgtcccacttttgacagaaatcacactgttttttttaatttttcatctggaccatctatttacaaagcaagccgcgcgtgtgtccctcttatgcactcacggctgatgctgcgacttttgcgtctgtttctgcctttgccttggcgtctgcggcctcctgctttgccacaatggccttggcggttgcctcccatgccttggcctgggtgtcactctgcggatcgtaaaagggcttctcacccgagaccgtgacgcgaacgccacgacgctggtatggcctaaaatcaggaacgcccgtatggaacgtggagcggttatcccagatggcgacgctgttcttttcccaatggaaccggacctggtactgcagctttttggcgatcagatccccgatgtagtccaagatccatttggattccgcgggggtgacaccattgatctcacgcgtaaagaccgggttcgtgtagacggatttccagcccgtaacggggttggtgcggatgaccgggtgctccgagtcattgagcttgccgaacgtcttgcggcccgagctctgggtcaggatcttgaagatgtcggacgagtgggtggcggtgaggccctcgagaagctgttggataggtggggagaggtcatcgtagagttcatagccgtttgaccaaatggtgtctccgccagcctcggggatctcttcaaacttgaggatcgagaacgaagccggtgcgggttcgaatgagacgtccgagtgccaagagtcgttggtgttgaatctacttggagggctgtgtgcgaaaaaaaaaaagaaacgaagtgtcagttacccattcagtgtatctgatactgtatcgaatctagcacatatcctcctctttttttctcgcgacgaggccttacctcaagcgagagtccaagacgatgacttcggggttgtcctggctatgagggaccagagggtggacatgcaagggaccccatcgtttgcccagtttgacatgttccttgtagtccagatcgtcctggtctcggaaccataccacgccacgttccgcaatcaaagccgcgagctcctcgccttgctgttccgttaactgagagagtctgatgccatgtagttcggttccgatcttgggagtgtaatcgatacgtttggtgacactggcaaagagggccttcttctcgggatctgcacccttgccggcgacacgggttgcatgggtgttgcggtcggccagagtggtctccttctcgctcgcagagaggacaatgttgttttcgacgacagtaggtgccatggcgtgtctaggaggtgtctaggaggtgtcttgctttggatgagtggtgggtagacagagatcgtttctgtttggtcgaggaaagcgggctgatggtgtgagaaaacgaagtaaattagcaagatccagcgtgcagactggattgcttttatatactggagatttatcagtagtatgtcagcatcgtgcctttaaacttgcgcgccattgagcagcacatggcgaaggaaggtattgtacggcgaagactgaatgagacgatttaaggtgccaggtacaccttggcccacaagcgaaaggtgtgattcagatcacgacatttggatacgtgaggtcgtgcgcgccagaggtgcaaaaagtaaaaaaaaaaaaagcacgctaacgatagttgggacaaaggcaacaactcttagccggtttgcccgtacttctcgtaacgccattctgatggcgatgttgaaccgaccttcaggggcccgcagacctgctggcaagttacaccatctccccatccggacaaaaagtacgctggttttgcatgaataggccacctcggtggaaccatctgcaccctagtgagtccccacatcccgtatggttccacagtcaatggtaaaatcggataggggtgggtgttcggagcatctatggagccaactggtccttcttcacgaccactgcactccggaaaagtgttgaaagtgacccaatgagacgcccaaatcgcgtaatttctgctcgagccttgcgcccggaaaatttcaaggtaaggtttccttcctcgcagcccttaaagttgcgcgatgcgccatagctgtgcagccactggcagacgaggatagcgatgcgatctgtcaaagtgaacatcggctgcttctggagaagtggcttcatcttctgcacgatctaacggcgatccttgctgctgagtcaccgagaccccctcgctcgtgcacctcgtgcacttgaactcctaccgtcccaggtgacgcgtttaggcatcgaataagaactcaaccacgacgcctgattgtgtagggccacgaccgcgctgatcacagcgcttgattgttttatttgtttttataaggtgaatggaattgtgtacagtctatgagggaatgcaagtgagaggaagaagcaagcgagccagcgctgccttctcctttcagtccaaaaaaagggtggcctagatcaagcagtcgttgttcaatggcgcttgggtcccttcttctgcttgacctgcttagcctgctgcttgggcttcttgggctgcttcttggccttggggacaccggcagcctttccaacagtgatcgtgacgcgctttcgcttggcaaagtgctcgctgccatcgggattgccagcaccgccaaactctggaatcaacacactgctgggtccgtagttggcgaaaagtggggccacacccgagatggagccgcccgcctttcccttgatgatgatgtcggcacagttcgagtacatctcacggttaccgatggcgttgttccaaatccactggaacgtggccttgcccgagggagcacccgcagggatggtgacggggaccgagtaaggctgaccaccgttcacgcccttgagacagtcgcggagcatggtcttgatcacaacccaggtcttgccgttgtcgtaggacagagcccactggcaatggccgccaccatgagcagcgccgacagagtactcggtcttgatggtctgaccggccttgtaggtcgtgcgcttggagtaaggagttgttttctaaaaaaagcgtattcgtttcatgtggagaaatttaattttcaggaacaggggagggggagaagtgataggtcactcattcaaacacttgagtaagcccccctgagaatggcctgaatgcttaccttgcagataggagcgttgatacggtcgtgagttccgataggcgcgttgatgtcataatcgatcgactggccggctgttgatgcagagagtagatacggaataaggcgcataagttatacatgcgcagaatggagcgagggagggggtgctttgtctgtcgaacacttttgaacaaacgtacgtgggggggcagggcaaccggcagcaggcgaatagcgaccgcagggcctggacaaaccaacgtgggcctgagccgtcaaggcagacaggcacatcgcggcggcagcaatgaaagaggttttgaagatcattttgatgaggctgatttgagtaaggaaggtgaatgagagtgtcaagtaagagtgagagtcagttggcgtcgagatgaagtgcgatagtcgtggataggaagtggagactgagagcgaaggaagtcgtaaagaggaaggggatgcagggctgctatgaagaagaggttgagggaggggcagagagggtgggttttatagcagaatccaagggtcgctgtaatgtttgcaacctgaaaaaccaagagaacgcgcactgacaacgtcttgcgctgaatggcttacagaacaggggtgatctttacatcagagagttagagaacagtacgctggaacaggtacccgagtacgtgaaagaatgaaaaggtggacttgcagtccgccatgattcgaccatataccgctaatactctatagctcgaatcatagtcgttcatgccaccttcgattaccgtacacctgaacagtccgctacatagtctaacagaatagctggcctttcggatcccaagatgcaggggaagttgtgaacagggacgcactgaatacccatgctcgattttatctaggcccttggacggtgtttgaaggtgcagccgcccgcataataccagctgccaacgagtcagccaacttttcgactctgtaaagagtgtgcaaggggttcatgtatgcgtttacatatatcttacccataaaacgtgaagctgccacacccatccagtttccctagacctttcagtgtttatgaaatcagttggaaggtacatgaaattcgatcgatttcaagttgtaaattgcaattggcacacatcggccttagccttttccctcgaatccaaacagggtttcccaagaagaatggtacatgcaaatgtatcctaccgttccatctgtaccactacagtatgtggagtcggcgtttgcacaagtacattttcatgccatcgtcccaagtcgcactagctgctcacgatgggaagcgcgccatttatgggcattacacttggacatgctacctagtagactacagtcttttccatcacgatgagcagagcacggtatagacttattggctgtattgtacatgggaacaagcccagcccagccatgagcgcgcggtaacgatctagacatcgaatgagacaagggatggagaaacagccgcaattgtttccggagaggggtattttccatagttacgttagcaccaaggatctgtggcctcctccaaaagaacaagtggaagccttgagcagtttggaaaagtggtacacctggacctcccgcagcattttgtattgaacttgccgcaatcttctcttgcaataaaatgcaacagcagtgatcctgatcgacaaatgatattacctactcactgatcgagaaagcaaaaaataatgtcgtcaaccctgtccatgacccatggggcaatcgacatgggatgctgatagcatgagagcaggcgcagttgaaaactcctcctatcacatagacaccagtgtacagtactgcaacggaggatgtagcgaccaagtgtcgcactgagatagcgtccttacaccagaggaatacctttttggtggcttgaagcacggaaggactttctgtcacggctgagatgcagatcggggtacctgaactcagtcactgcattttttccgttcatggggcacttccaagcggatttcgtcgccggaatggctatggctccaagcatacagaggttgggcgatggtccatgttaagctccatgtacgtgtactgcatatacatgtacagactcgcgtcgcgacggccgcagggtggaagagcggataatgatcaaagattttttgcaacgctccgccagagcatcaaaaaagtgctctcatactcaaattgcaatttttttcctaacttctcctttcatatcaattgggcggagtggagactaccaagatcttcaccccttgcatgacaggtccgaagccgtctcagagccgtgtaacatccgcatcggaaagtagggtatgcaaatatatttgtttggcgttttattggagaatgtgctgctgaaaagaaatcatccggttctcagggtacccataatggaagccggcgccatgcccctgagtctgtcagggtgggaaagagtctcaccaagacctgtaacaaacatgagcggggttgctataggcctcggtccttgtaagacttgaatgaagagaagggtttcttgtgctcgatgaccaaatgggggtgtgctggaacaatgttgtggccacaattgaacccagacgcactttggcatcggcccccagttcagtcgtccgccggttgcaatttcaagaacattctttttttcttctttttcatcccacgttttttctccgtgagcagaaacgtcagcaatggtgtatgtacagtacttggcaatgacagagtagactactatagttaaaagatactgtacagcgcgctctaggtcaccgcgttaatcatcgcttggaggatggctgttctcgaatcatggcacagaggagcccacacacagcgcttttcgtcaggccaatcaagcgatgttgggccatcgcaatatatcttcgcgtggagttccttcttgcaaagagagttcacaagcgaaaaattgcaattttacgatcaattctgataatgcaggtccatctggtagaagaaaccttttttgtccttgcactgaggaagagttgtacacgccgtcgggttccgacactggctggatagaccgcgtttttgcatgaccttgtacgcgctcatatctaatagcaaacaaaagacgcactatcagatgagttgtcaacgagttggccaaccgccaatccactcgtctttatctctgcctatgttgcgcgccattcccgaatattttaggcctagacggtttgtttgtgtgtcgcttatcatatggcagctctgttaactggaatgttatacgcaagacgtcaagaagcaaagaagcaaaaaagtaacgaagcaaacaatggctagggccatgttgacgacaacgagaggaggatcatcgtgaatgggtgtatgtgctgtgataggggaaaatggtacccccagttgtttcagaccaagacgcgttcgcgtaattcagagcatcgctcggccccaggaggcaccccttcgcatgcacccctacatctaggaaaatgtacatctgctggtattcgcatacacgtgtgccgggcgatcgttcccaggaccgtcagcgacccggttccgcagtgcctagagaaggatctcgctagaaactcagaagatattaggtacgcaccagcgcccattccttggccttccacgagaaaagacacagcacgacagaaccatcactataccgcggttccatgaacctatgacagaaaggaaggaagtctgtacgctgatcaggcgagagcaatttgtaacattttcattttttttttcaaacttcgacaacctgcactgtgagcagtaaggagagaaaatggcttgccagaacacagctgcaggcacaaaagtgagaatttgagtgagcgatctgcgagcaaacggctgatcagtcgagccttcttgcctttctcatgaaatcgaccccctatgagggtgatccaatcccagtcaccggagggcaagagtgggcatcattccttgtcagttccgactaacttgcgcaagttacggaggaatgagatgagagccaccctggagaagaaatgccaacggaccaaagtataaaagagacaaggaacgaccctatttttttttctgttctccattgtctttcaacgcaaccaccttcctctacctcaagcagccccacccacaccagcgtaaacgttcgcactcactcatctaaccctcacgcgtcaacatatcaacaccgccaccacacaccccgcacctccatacccatctcattcatcatgcttttcaccaagactgccttcttcgttgccgctttggcctgcatctctgccttgaccgttgaggcccatgtttccatcaagaagccctgccctcgcaacggtcctttcgctggctgccccaagcccgccaccggcgagcccgattacgacatcaccgctcctattggaactcacgacgatgcctcgaagcagcccatctgcaaggtacgacacgattcacacaaaaaaaacacgacgcgtctctaccccccccttttttttgctgaagccgagctctaatctctttgcttttcttcacctcaaacctgcaaacaacagtctaccacggtccagaccaagcgcaccatcatgaaggccggtcagaccatcaagaccgagtaccaggtcggtgccgcccacggcggtggacactgccaatgggctctgtcgtacgacaacggcaagacctgggttgtcttccagaccctcatccgcgactgcctcaagggtgtccccaacggtggcagctactcggtcaacgtcaagatccccaaggatgctccttcgggcaaggccatcttccagtggatctggaacaacgccgtcggtaaccgtgagctttattccaactgtgtcgatgtcgagatccagggcaagaagaacggctccatcaagggtgtcgtcccccttttcgccaactatggaaagaagagtctgttgatcaaagagttccccgcagccagcgacaaagatgctcatgaggcctttgccaagagaaaggccatcaccgttcgtgcccccggcgccgccgccgccgctcccaaggccaagaagcccaagaccaacaagcactaaagaatagcacaacataccctaccccctctctctcaattgatgctcaacagtcagctcgaggggttgatatgagagggaggtggagaccaaacaaagggcgacagtggatgttcatttaaaaccaggaataggcgcaaaagcgtttcgcacattcctggattctccatcctttgaaccgacacactcacccttttttttggatctaccgtttacgcatacctataaaactaaaaagaataaacctcatggacacagacggaggggcgaggcagcagttgctggtcaactgcacttcatcctcctccctttcggccctccccccaaatctatcgcttgcacgtctattttggacattcaatttcatcaaactgctccgcgggtgaattcttccatattcaatctattgactgcattcatgcatcccctcggcgtcaagaaatgcccttctaaaaaaaaataacctcgtttcaaacggccttcttttccttcagctctcggatccgtgcttcatcatacccgagcacatccctcaagatctcttccgtatgctgacccagcaagggcggtggaagccggatgctcggtttcgtgtccgagtacttgaccgccggtcccgtcaccttgatcctccctgccttgggatggtcaatctcccggatcatgtccctcgccaccacctgcgggtgctcaaacgtctgctggatattattgatcggtgcaaacgggatccccctcccctccaaagccttgagccattcctcattcttcttggtcttcagtctcgccgtcaagatctcgatcagttccttccggtgctgaacgcggtcctggttggtcctgaacaatggattctcacacaacggctccaatccgagcacagagcacaggatccggaactggccgtcgttaccggctccgatcatgatgtgcgagtcctgactggggaggacctggtagggcacaatggacgggtgggaggtccccatgcgttgggcttcttgtcccgcaatcagatacgagctcgcaatgttggcgagcgtgaccacctgagagtccagaagcgagcagtctaagtgctgtccccgtccggtcctgtaccgtgcaacaatggcggccatgatggctccatgggcgtagagtccggtcgtgagatctgaaaaagaaggaaagaaagacaagcacaacaggcgtgcaagagtagtgagacatgtgttcatgcattagacaaaagcggtgaccgggggggggggggggggttcttcttcgggaccaagaagtacctgttacagcaacgcccaccttcacgggtattccgttctgctcgcctgtaatgtacattagtccaccctcggcctcaatcatgacgtcgtagcctggccgtgttctataagggcccgtctggccataccctaaaatacaagacgaaaaaaaaggacgaacaaggagacaataggtgttcagttgagccactactgtcctgagtgtacgacaatgggagcatgtagaaaaagaaaaaaaaggacatacaatctgcatacctgtgatagacgtataaatcaacccagggttcagtgcactcagctccttgtatccaagtcccatgtcatccagttttccagggacgtaattctcgaccaagatatcgaccttcttgaccagatcctgcaccagcttccgtccttcctcggaccggatgttgaccgtgatcgatttcttgttccggttcactcccaagaaataggcgctctcctgtgctggatcggaaggatccaagttcttggcaaatggtggcccccacgctcgggtgtcatcgcctccctttggattttcaaccttgatcacttcggccctaccagattgaacaaacatataccaatgggcggtcagccattcatcccctgtcgaaaggtcgttcatcacaagcgacgctatatagagtcatgtacggctgttgctttaccccaagtcgccaagcaactgcgtacagtacggtccggcttaacacggatgttgcgtgaggttaaaggataagagatgatgaagagtttagtgaaccgtgaaaggaaagcgcctcgtttccctaccattcattccggcgtgtgttttctttttttttgtatgcttgtcgcgattacccagaacacgggtcaggtccagcaccttgaaaccgtccaaaggtccggcctgaggctcggatgttggccgatccgatcggtctttgaattgagcgcccgtgctgctgctgctgctgctggtgtctggagttccaatgtgactttcttgatgagtcttggccagcagtgactccagtgtcggggggcctccgctcttcccgtttcgcgcatccaggctggtctcgttatggtcgggaccgcgtcgctgctcgtgctgtcgattgtaaagagagaaggcccgttgagactgcgtcgagcagagagtgagccggtgcctcatgagccttgtggcagctgcatggggtgtgaatgaagacgagtaggcgtgtgggctgtgaatggaggacgagatcccaccgaggagcgaggcgatgcgtcctgaatgaagcgatggcatctgtgcggtgcaatcgaggttgggagggattgagagaaaagagcaaacgagagaaagggaaaagccgttgggagggtctcaggcaggggaaatcacacagagcgctactggggcgtgccatattgggccgtactatccaaaaggcgctagtctgcgtgcgagggctgcgcgagtgccgcacgctcgggctcatactctgtcagcgtgggattcagccgcgtcatggccagcatacgcgccctgctgtctctgctgccgctgggctcaccaacatggtgctggtagtagtgaagatgataatgatggtgatgagtgggccccgggccgcggtgtccatggctcccttctttcacgaccatcgaaagacttcgtctgcgtaacggcaccggcctcgcaaggatgactccactcgcagaccggtgactgtgtggactgacaaggagcgagcatgatgccgaacacgatgtcgacaacgacgatatctcctgcggcgcgagcctcgccccccacgacgatgaagatgtcaagtgtaccatggatcctgacgccttgccaaggtcggcctccaatgtccccgtcaaagctgtgtttccatggtgcattcgttcttctccatcactgctgtcaaaactgtcgctcgagctgccgttgtagtttccgctggcgctagagtgttccagactgtggtatccgtcgtcaaccatgtcatcctttgcctttgcctttccagttgttgttgtagatgcctgccccaaccacacgggcccatgactctcgaggctctgaggtccagaaaccctctcctcgctcatatcgatggctagacaggcactatgccatcccgccatgccaatccggatcacaaacttgtttttcaatggtccctcaaccacagtaggcactgcgcaagctgttctgaggtcaccatgccctagagcaccatcacaaaacgcgccccacgtccgaagctgtccgtcctcggtcagcaatccttgatgatgatccccaaactcgacctgactcgcgttcgacaccaggcgctccatgatggtcggtcggctgccggcctgtacatcgtgtcgacccaacaagaccttgccagaacaatgatggatggcgaattgctcaaagttggctgagacagtggtgggatgcgacgccgacgagaacgaaccccatgtcctgcctgctttgctgttgcttctccactggtccgttgaagacaatgacaacgacgacgacggcgatgacgatgatgatgactgctgttgctgatcctgacgactatgcctccgcctgcgctcacgttgatcgttctcctcataagactccgtaatggcgtgcgtcagggcctcggaaaagatgggcagcgataacccggcccccaaaatcctgcctcgaatctcgaccacgcgttcctggagcgatccctccaccagtgtctcgatcacaatcctgctctcacgctgctcgtccaaatcctcctgccgccaccaggccggcgaaccagatgcacctgagcgcgcctgcagatcgtgaggcgaatctagtgtcctgaacaggtacaccctctccaatgaggtcacagcgacaatataatccgacccgaccgccatctgcacaaacgcgtccccgtccaggaccgcggcctcataccccgtcactccctgacccttcaaacacaccgagtgccccacatgcacccgatattggtaccgtgaatccgctgacggaggcggccgccaagcaaagatccgtccggatcgcgttaaccctgcacagatatcccaccctgcagccagctgcaccaccggatcttccatgtccctgcactgtgttgttgtagaagtcgtagttgtagtcgacggccatcgagtggattctgagcaagaaaaggtcacctcacaaggcttgttctcgcgacaccactgccagacctggccatccgcatccttggccaggaccacctgccttcctgccacgagctgcgtcacatggcgaggccacttcagcatcctaggctttgcatctgaacggataccattcgactccatgatgcctagagaagatgtgaacacatgagttgacaaaaacataaatgcagtggaagggggggggggggggttgaaactgggtgtatcacttacgaccccatgcccacacattgccatgtcggtccagcgcatgacagccccatcctgtgggcgccaactggacgattcccataccatccaggcgtcgaaccctcttggggacactctcgtacaccttcttgggcgtccgaccgtatccgagtcgacagtcgccattgtttcctaaaaccataaaaaaaaaaacagatagcgagagattgaccatggcgcagacatgagggtgagggtggagggcatatatgaccatgccatagtgtcatggttagtttgcagttatcaacattatggggaaccacccaaccgcctgtgtgcaaaacgcctgtcatggttatgcaagcatgatcgtcactcgcaaaaatcccgtatatgttgtgaaaaaaaaaagttttttaccccaagtataaacctcaacgcggtccatcgcttgataaagccgcttccaactacccagctggcggagagtcctgtgaggcctgaacgcgaagtcatgaaagaactttttttgccagagatagtcggtctcgcagaggtggtgcagatctctgcacactcgggacagacagcccagctccgtgagctcgacggtcgcgaggatttggccgacaaggatctcgagcggaagtgtgagaagatgaggtgctgtgcatagtcgagatcgagatatcgagggtgctggtgctgatactggtgctgctgttgttgatgaaggtcctgatgcaacagtccgtcttcgtagcgtcatggctgtggggtgaaggacatgataatggctcgtcatagtgagattcagggtatgttgaaagaagaaaaaatgtcgagagaaaaaaagaagtgtgcggtttcaaatcttgtttctttctctgcctcaccccgtgcgcggtgaactgtaatgatacatgaaaatttaaagctactggcccatgcgctttggtcaaaaaaaaccccaaacaccaaacggccttctaccataattctactcttcgcccttgaagggctcctccttctcttgctgctgttgctgctgttgctgctgcttctgcttctgctgctcattctgctccatcttggcaatcgtggcccgtcgctttctcgagaaataatccacactgcgaccatcgagctggatatgcaacgccgacatcaccgcctccgaaggcgtgatcgttccgttcattccagaactacgtctcttgccaccactctcctgactcaacacatgacgggcttgtcgtcgtccactctcactctcatccccagctcctcctccggtgctgtcgtcatcgatcgatcgcttctgtccatcactcgaggacgatccgctaccctgccgttcctcccgcgtcggctcatccgagtcccgtcgaccattgacgtcgccacccgcaccagctgcctccatggcctcagaccgagccttcacactctgtcgcttgttctggaaccagatctggaccgtgcgaggacacatccggcactgcttcgacaacctcagacgctcctccgtcgacgggaaatacgatcgctcaaaggccgcattcaacaccgacagctggctcgcattcgccctcttgcgcttcgccttgaccgcataaaactcatcgtccataacaatcaaatcctcctcatgcccagggttcttgatccgcttgggcttcttggacttgccagacttggactcggtcgtgtcaaaggggtgaacggacggagccggtttcgaaggccgcttcgaggacgatccatgctctgttgggttcgtgggcagaggataattgactggggaatactctcctgcctgatgatgctgagcatggttggagcgatagtacgtatccggatgctgataggatggatgcgcctgtggtttgggtgcaacactgtgcgcgtagttctggtaccagctagggggcttgatgtccagagagggcgactgtggtcgcgaatagggtcgagaaggcgcgtacgaggacgggggcatagaggaggacgtctcatgagcagggggtggacgctgctgagagatcttccacccgcgctcctcatattcgtatcggctctgttgctcttgtggcgtgtagcgtcgaccagacatggcagaatatccgtacgcctgtgatccataggctgagttggcgctcgatccatacgatcgcgagtatccagcagcgtcctcgcctacagtatgtctccttgcgctctctccctccatgctgtcgggtatatcctgcaaaggcttcgagtactgactttgtctgtatgaagctgacggtggtggtgggggcatacgctgaggaatgtcggggtctgcggcgtcgattccatagatccgacgcggcttgggctccatcttgacactagagtaactagattcgtaaggtgccattggcacaggtggggcagacgcggacgatgaggaggcgctggttggggggtacggcggaggcagcatggacgagctgctgtaggaatatggtcggatttcattgggtgcatcaacgggcacgacgcgggtgggccgtgggacgggttgccagatctcatctgcggtcgagtcacgaccgtaaacccttgggggcttgttctcgggcgccgagagcatcgcctaacagagaagagatgacacaccgtggggggtacgtgtgagaatcagcgatccgatagtgggcgtgaacacaaaaaacgagagcgcctgcacctcgcgtgttggcattgtggactgattagagagaaacaagatgcaagagggatatagaaacaaaaaaaaaagagggcgggcgtgggatcgcgcgtgcttgtgcacattgtggttgtgcgcatggtatagggcccatgaatggaaaagaaaaaaaaagtgcagagcacaaaggagggagagcaattgtgtatcggtatgtgtgtaaccatgcgtcggaagggacagaggccaagggagaggtaaagacacagagagagagaggggagaaagggagtgtgtgcatgcgtgagatgcaacccgacaaagagtggaggaacggacacaggcgagatcgaggcgaggagcacaggcagcaggcacaaaaccgaggacagagaaagcccgacgagatggggcattgcataagcagcccggtaagtagctcaatgacaaacaataaaggaggtgtaaagaaaaacttactgctggcggaggcaggatggggccatggccttgcctgaaatgctgctcgcttgggctagcctcggacttttggacgtgtgcgtaattatgcatggcgggccgagcagaggacgaggacggcgcggtggaggacggtggtcgtgggtagacatacggggcagacgaggaagaagacgcgggcgaggatgatgagaccgaaggtggtgcggtatggggagggttataatacagaggagcagaggagtcgatgccgacaggcctctttgtggcagcagatgaatacacggaggccgatgacggcgctgacgatggcggcgcaggcttgtagttgtgaggaagagcagcggcggtcaggggcggcgatccattgagatagggcccatagttttgctggtgaagggcgtagtcgctcttggagcggtctgttcgcctctggtgatcctggtcctggtcctgctcatacgcgtggctgtagtcccggtgccggtccgtgttccatgaggcggagcgctgttgtggacccgctacgctggaccgaggtggttctgtgtacgagacggcggcggcggaggcagcgtagggcgtcgatggggatgcggatgcgatcgagaaggaggctggacgcgtgcccgcatggctgtggggatagcgatcgggatgtgttctaaagggtgcgctctcggtgtgtctgtgtgagtacaagggctcccggtcgctgcctcggtgttcgctcgcgtactctcgctcgacacggcccgcatagtggctgtccctggtggtggtcgtggtgctgctgctgttggtattgcggctatacggcgatgtgtgagtagagggcgcctcgcggtcatcagcttcctcggtgatggcgcgcagcggcgcaagctgttgtggtgcgcgcgtataggcgctgtcccggtccgcggcctcggaggagcagagcagattggcaatgtctatgcgcgagtgctgctgctgcctggcttctgcagcggatgggtcgtgatccagcggccagtaacggcgtggctggcccgggtgcaggttgccctgggaggggtgatcgtggctctggatctttgagagggcggatttgatggggacgatggcctgatccagactggtggtggccgtcttgacgtggatgctgctgtagtgatggtgctctgggggggagggcatggatgaggacttttgcagcttcgagaacgagtgggggatgggcagggggtaggcggacgagacggtggccgagggcgagtgagtgacgcgacccgggacgggctccatgcacggaaaccggggtgatgatgttgtggacgaggacggcgacgagggcgaggagcaggcgggcgagaagttctgggaggaggcgcacgacgagtgtgtggagtgggacctggcaaagggtgtaaacaggggcgaggcagagagcgacgaggacacgagcgtaggggtcgacgtgggcagggcaaccatggagggagttgcgaagcaggcgagagaggagcgcgcgagagacgagaagcaagggacaagaggacgacgagagagacaactgaaggacgaggacgaggacgaggacgaggatgaaaaataagggtgcttgttgttgttttctttttttgggttgtccgttgcaacgtcagtcgagtgtgcaaagtgtgcgtgcggtgtcgctattcctgtattcgtgtatgtgtgttcctgtaatcctgtatcggtagttgctgctagtccgctaatcctgtgcagtggatggagggtgcgaggaacgagcgacgcgagggcgagactagagagtgtgtgtgggtgcagaaagggctatgctatgggtgcatcgggtgctgtatgacagtgtggtgaagacgacaggcacgagagtgggggtgggagtgggactattgaacaagagagagagtgagtgagtgagagagagtaagtgagagagagagagtgcgtgcgtgtgtcgataagagtcaagaggacgcagaggagagggacgagaggacgaggaggaagaaagtgggagaagagagagagagagcgagcgagagagaataaagagaataaagagaatacagagaatacagcaacgacagcaacgacagccgacagcaaaggagagtgaaaaaagagtgcgagagagtgtcagtcagtccgtctgtcagccagtcagttggatagcacgataataaaaagtgacaaagaacatcgcattcatctcccagcccatggtgcacatccgcgtctggcaagggggcgagcactcttcatgtgtgttgtatgtgttgtgtatgtgtatgtgaagggtattgcgcatccgccgtccagtccgtcgttcgcttgtcctctacgacccacaaccaccaaccccatccacaccccccttgacgagctgtgttgatgggggatgacctgttggttgcaacaagcgatgtacatgcggatggataaaggccagcaagcccgagctcccatggtcaaaaaaaaaaaaagtaggttctgttcatattgaatgcaatacaacccttacaatactctcaatgctgttcaattgttcaataaataacatcgaccctattgagagccgtattctttttttcttttctttctttcttcttcatcttgtgtgccaggcaggggtggagaacaacgaaagaaatgactgcacacacaccctgaagcttcaagaaccgcatccactccaaatggacccaatttgccacagcgtcccttagcccttggccctcggcccctcttgccaccgctgttgctgaatccacctttttaggctgtcaactcgaagaacgagaccgagagatatcatcatcttcatcatcatcatcatcaccatcagaaaaaaaacaaggggtttcgcctatgtgacagaagggggttttcggcacggagcgagccgcccatcacctatagtctacagcgatcgctcagatcaaaaaaaaaaaaaaggagagtgtcctctgcctctgtgggtgtgtccagcatttctgaatcaaagagcctcaagtgccgcgcccgaggctgcggctctactttagcatcttggaagaaaccctcccacttctataagcccagtagtagtgtacccttactcatcctttgctatatcgtacatagaccatttgtcgtttctcattcttttttttttcccttctcatgtggcacgagacatgaggtacatgggcgcggacggatagagttttggaagaagagtaatgtatgcatgggctagatcctggattgctaagcagacggctcatcccatgtcttgctctctcacactctactctatctcctctcacacacacacactctctctcttgcatcaatctctctcgatctcatttcccccccgttcccttggcgtgcgtttgttggacagtaaaccccaagagatccacagtaaaatgaacgcgcggaatgcagcaaaaaaaaaaaaaaagaaacaaagaatgaaaagaatgaaaggagagcaaattaatcactgatttaagaaaaaaaaaagcagatctcccttcatgcccgataggatattcctagaaagtttgcacaggtacgtaagttgtgcacgttgaatacatggcaacagtactgtagagcaatcgggtaagaggctgcgcggggagggagggaaggcagaaggtgaagagagaccattgtcaaagataaacctcctcccacaactacaggaagcaccagaacaacatcggagccatcttttaaaaaaggcaaacaagatggagagatgggaaaagggagggagagccaaaggcgaggaaaacacaagagacacaagaaaatctcaagcactcaaaggggttagaacagaacggctgaacgttgatcgctctgtcagcctgctggaaagtatatatattagcccgttctactgtgcgcttagcatgagcatagtggatgcccaaatgaagagcagaagagtcattggatgggtcgggtgagggcatcaagggaggcgaggggggggaagggagaagacacacaaacacgatacaatagacaaagtgagagagacagagagacaggccgcagaggtgggaccgcacacccacagcacttggcgagatgatgcagagtggacagagagcaacaggtccagaactttgagcatgcatgacctctctcaccgcctcatggcatcatgtgtacctcttacctcgtaaagaatgaacggctgaagggatgtcggggtatagagtcagcaactgtttcgtaggtctcaagcggaaactctctcctcgtttgtgtgtgtaggtcgaaaagaaagaggcaggacgacgatgtgggtacagagaggaaaagaaagcgtgagcgtggaaagggaggaggggactagaaaacgcgcccgttaatatatacgtggttttgtagggttgggggtgtatctgcgtctgcgtgtgcgtgtgcgtgtgcgtgtgtttacctgtactgttctttgcggaaagagggggcagaataggatgaacgatgcctcgaaggtcaagaatcaggaaaatataaaaacaacaatgcggacggtcgtcgtgcgagcgatggtccgaaagacaaggaggaacacacagtcggtggtgtcgaagggaaatcaaagcaaaaaagacgagcacaagagaaaaaaggatgtgccgcgataggatgaaaatctttttttttgcgcgaaaagaaaaaagagtttctttttatgtcgccagagctatctgagcaaccgtggacgctaaagaaacacaagcaagccgccctttggcttcgtgcgcccaccgaacattgccctcaaccacaaaggactctgggtggttgcaggttatccgcttcatgaatagcaagcagaacggcccgaggcctacttacttgactgaattgagattgaatgaacgcaggcaggatgtatgcaatgctgagaggagagaatggggaatgtcaagggaaaatttctctgccatgtaaaaggaacagagattcctagaaggtgcgaggggctcaagcgacctcatgacgaagcgcaaggtagctgaaagggacagcgcaaagacggaagaagcgaaaaaaaatagggtcacggaatgggtcctaccgtccacagtgaaaaaatcacagtgtccaaaaggcaagagagtttgtggggtcagcccgcccctccttcataggcgaacttcgtccggagttttgtgtaccatgcattgctgagcgacggtctgcagtaacagatgcgcatcatcctgcagagtgcagcaagggtatcaactccgccctctgaacctgctttcttgcatagctgtggcgctgtccactttacccagactacagtagtagtctatatcaagctccggtcatgcggccatacagtaccagggaagaggtctgagactcggtgttgcccaaggccacctcgagtgaatgagaatgtgtgtgtgtgagggtgtgagggagggagggaggggacgagcgcgtggggggtttgaaaaaaaaggacgctcaccgccgattgcggacgccaatgaacatcatttttgtccaacaaacgctctttttctccgatctgttcagcctacatcctggtgttgcgatagtcgcttgttccaaaacacaccgttctctcactccctctctttgtttccaaccctcacacacgcacacacgcacatacacacacgtagacgctctctctcactctccctcctttccgcacccttgttctggtgaggaccatcgcccagagagggacgcaccaaagggtcaaccaaaatgcgcagacaacaaacaacctgttgatccctttcacaccctggcgttttttgtaccacatcgcgaaagcgccaaaaaaaaaaaaagatggactcccccttccccatcatccttcatccttttgaatcgcgttcataggaggtggaggatgacccttttactgcgttgcgatgaagaacatgctcgctactacatccccctctcgtcgcgtcaccctttaattttttttaatgtgtttgcgtcgcaaatgcagcctgcaaatgcaagagcgatcccctgcaccctttgtttttgctcaaccacatcatctcagagagccagaaacacaacaccatcaacaaaagagcgcccatgaggaacacgagaacaatgggatccgatcaaaggatgggtcatccgtgtacagtacataagaagaaaaaaaggcccgacactacccttgcaaaaggaggagccttccacaaagtctataaaccgtgagccatacctaaatgaacctgaggatgaggagtgggagaggagcaggccgagggagacaacctcgttcatccacttcttctgccccatctctctgtttctctactctattctgacttttctcttccttcatctctcaaaggcagaagggccttctggttgcataaatggactgagttctggtatataaattctctctgatcgctttcctgcaatcttaactcatagactacccaccgcatatgggtaacaataagtttttatttttttatttttccgtaatgcccatgcccttccatcaccagtgttcaatccccgccacatccttcttttcactttttgccgcccattcatttagggtccgttcccagcaatgctgcaaatgcactgcactgtctcactgatatctgaacggctcttttttttcttttttaccgtttggtatattgccttaatcttgtttgttggcagaagaactcatagaagctaaactagggaaaagaaagatgacgagtctcctcacgcgaacgcaacaagcgtgtactctctctcgactcccatggctaaatagatcgcaacgcgactttttttttttttttttgaccctgtctaagctttaccgtcatggacgcgttacacacacgcgcgcgaaaaagtcgcgcacactttggatctttcccctgtcacggtcgcagtcacatttttttttcctttatttcagtgggttgaacgagagagaaagaagaaaaacgacgggggggggggggggggtgcagcgcgtattttgtactccaagggtgcatgtccaaaccacgcagacatggggggcaaagcaaagaaaagggcccgaaaaaaaaagaaaaaaaaaaaagaaaagaaagagaaaaaaaaagaagaaaagggaagaaagaaaaacgaggctgaaaacccatctcacacacatacacaccctgtcgcttgtgtgtgaggaaagagtgtccctccagggagactacaaatcgatattaaataacaatgctttttttgtttttgattgaagtacagtcgctttttttcgttgttttttgttgtttgtcggatttttgtccttttttgaaagattgttgtttgtttttgttgaagtggtcgtatcgttttccatcttggattgctgaatctcaaaaaaaaagaaagaacaacaaaaatatccctaaacagcggccgcaatcgcctggggtgcatgtcgaggatccatgttctccttgacgtcctcttcctgtccagcaatggccttgcccgtgaggacccttggcgatggtccactgtgtcctgcattcatcatcctggccgggttcgagagcttcctcgctcggggcacttgggccttgatctggaacagattaggcacagcagaggacgacatcacatgcgacgcttgatgctcagtgagctcgagcgtgaagctggcgtacgactgtgtgatgttggtggtggaggggttcagaagcagctggtaggggctgttgctgatgcgcttctcttctttcaggctgcgttggtggctcttgctgctgggcatgggcatgctcctgtcgacaatgatttctagcgaggtggcagaatcgcttgtggtcgggcgagctggcaaatcctttgacaaacggctgttgcggtcggctgttgagccggactttgagcgtgaacgagaacccgagcggtctgtggcagtggagctgcgcggagagctcgagggcgatggtgtcgcgtacccgagcttgagagagtgcatgatgctctcctcgagcaaggtgcgacgccagagatgggcctggtaatgcttcatgctcgggtagtcacacggacgcgcatcgtacgatgacgccgcagaggacgatgtcgcagtgcgggtcgtgcgtgccacggaaaatgtcgaggacctgtcgcggggcacaggttcgccattctctgtcggggccggggggttctctgggccgtacagccttgaagaccgctgctgcggcgatggtgtgggcagtgagtgttggcttagcgtgctcttccgactgctgttgctcttgcgcttcttcctgttgttgcctgcgtcctctgaccggcgttccagtggatgttccagatgttcagtctcttcggatacagccttgctcgagagcacgttgaccgctggacgatcctccatcgacacagagttcctgttgcggccctcgagcgtgaacaaggccgacagtcgcttctgagctgagggccgacgatgttgctgcggtttgatgttctccagatttgcaggggcgaggtcgtgcaggctggcctcgctcgcactggagtcgtctctgtagctgctcaacctacgtccaatcttggtcgaggatcggagatagtttcgtgtcgattctagaagctgaggcatggcgtctcgtgtgtgtgtatgtgggtgtgcagccgggtcagagggatcttggaaggggggaactggcccagacggttgacagagcgggctttagggtggaaggaaatgtgggagaggcgaaaatcgtgccctgcagacttgctaccactgggcagttggacagacagacagacagacagacagacagacagacagacagacagacagacagacagacagacagacagacagacagggaaacagacagacagggagacagacagacgcaacgagcggtcttgcccaagtggactggccgcggcacgaaaggaaagaggagtccaagaagcagggatggatggacggagttgcaaagtgtcgttaaaagcgtaacagaataaaaagaaaaaaagaggtaagaaacaaaaacaagggttgtgtgttcgcaggcactgagggaggatggaggtgtggggtgtagaaaagggggaatgcagccgtgtccaggagagggtgattatgcactgcgaatgtcgtgaaggagttgctgacaactgctgatgatggcgggagagagagaaagagcgagaagagaaaaaggggaagaaagaaaaaaaaaaaagaaaaaagaaaaaagaatgacccgcgcagagtagactagcaaacaggaataaggaagagtgtcaagaggagcacactattcttacgacgatactgtctcaagccaagtggcacagcgttggtgaagaaggagggggtgacggaggtgaagaagaagaagaaaatgaagaggacgaggacgaggatgggggttggttgtctcttctcgaattcgatggaggaatggagaaaaggaacaaggagcaaaaacgaccgccagccgaggcgtgtttttgatggggggtgtgaggctcgggctgggcagggtaagagcgcggagccactgctggaagagcaacgaggcacagacagcacactgtcgtgtatgtagtcgtactcgaggacaaggacaggggcagtcgtgcacaaactatgtcttatcaggtactacctacagtactgcgaaattggcgtagcggaacaacgtgtcgagcgaggcaatcgatgtacgatatataatatatgaatgagcgcagaggcagagagagtgcgagcgagagatactgggggtgcgatacaaaaggcgtggactgaggaggagctgatgcaatcgtggtgcgggtggacttggagaaggagagacagaaggacagaaagaggcacaccaacgccaggtggccgcccgctttatacgctcgatcatctcactcatacttgcacagggggcgagacatggagacagatgcggccatggagatatatggcgatatatggagacatatcgacagagggagacagagggcaatggacgtgcccatgcttggcgatggcacatgagagcgagagaagcggatcagcacatggcccaccactgcagtcgccaacacacacacacacacacaagccaaaccaccgtcagcagtgtctgcagcttctgtccctcgggcatgcacccttacgcgcgcaagtcgacactctgcagcgatcaaaaggcgaacgcggcatgatgtctgcccgtccgtgcctgcgagcgagcacccagacgacagggcaaagagtgcgatcaagaatagcgacgtcccttccgaggtggaattgaaggcgaggtgcatgcgtcctcgaaccaaccagacagagacatagatcatggcccgacccaacccccgggacaaacggccgtttcgagggactgaacagcatacaaagggcattgacgagggcatttgcatgcaaggaacagggcaaaagcgggacaggtgcaattacccttctttctctttggtcctgcgagccgactccaaacttcccagaccccatggaccttgcccgccccgcagccagcccacaccattccctctgatcgaaaggacagacacatgctgcagtccgcactttttccgtttctatctttgtccctcccagagtcccagagccctacatccccctccttccctgtccctccttgccttcggttggaacagggcgtgttttttttaggagacagcatctggacaacaattcctcacacgaataatgattgcgctgaacgggagatgcacgcggaaattgttgctctttcatgtgtcggctgtcaagaacggctcagtcggggtactttttttttttttgttgttgaccataccagtgaaatgtaccacgaaagaagctatctatcacttatcttgtgaaaacgacctgaagacttcttgaacaggaagccatgaggccatgagacatggatgccagcaacacgacaccacccattcccccccccctggatcatgtatagctatatcctaatcctgtgcccatctcaggggctacataccactcgcatattggctggtgggataggctcaatgagctactttttttccggtggttgtactcgtggacagcacaaggagtcggatgtgggcaagggtcgcgtggtcaatacaggaatctacgggctcttctttctcggatgtattttcagggcaaattcccatgcttcgttttttttattcggttgttcgcctcaacttcagcatgacctcaagataatgcgggtcattggcccagtcaataccactctccagcaagagaccctagcgagccattacacaccataaagcatcaatgagctgcatccaaaactgtcatggcctacgcgatgccttctgttgtgggtgcttacctgtaatacattcgagacgacactgtgcttgataacaacattttttagctcttcttccaccctaatgcaatagtgatcccattggagtacggtcagtcaacaagcacaaacgacaaaaaaaaagccattttagtctcacacgatcgatctgcttgacgtgaggacgcccattacctgtgagccattcgacgactgctctttgaatcctgagaggccatagcttccttcatagccgccgtttcgagagccaacgattgcgctatagccctgttatcatcctgacagtctacgcatgcaaaaaaaaaatgtgaaaggagcctgtcagcctgtccctgtggaaactccaatgattcggtcattgtcataaaggcatccactgttgctggaaagtcaaacgcacccaaaacctgaacttgcaccgctgagagatcccgtcttgccttttgaagatcccgatgaatatggagatacttcgatacagcctcgtcccgttcctcaatcgcactggctaatgacctggatatatcgtaggagttcggtcagtccaacaagaacaggcaaggttcgctgcattgagaccacgacaccgtcatttagtgtttcttggacatacttttcatcctgatcgtggtcgcccttgaaaagactcttgagcactacttggtaagcatgtgcactgtccacgaccttgttgcggaccgtctccatcgacacggccgtcgtcagctcctgcttcagaaaatcgatcctttgctccagctcctgccgcttttcagttgccgatcgaccatcctcctgcactgccgttgcgtctattgataacgagtcgatgaagagagaggggtgttgcctgttagactctgtgagaattacccgctgatagttggaccaaaaggaggcggatgcatagctgacaaggcattaccattctctgctgcaaactctagttcacgaatctgcgcatccagccaagcttcatggtcagccagctgtagaatctggtcctcgagagttgggatgaccgcggcggctgatgaatttgacgagggctctgctagtgttgactccatggttttcctcttcgttgttcgtgtggaggggggtatggaaccaacgtgcatgcacacgacagaacgcgagttctgctgaagcaagcgaagcaagcgaagccacagcctccgttcgggcgaaattttatgcgccaccaacaactgcaagcatgctgagcaaaacgagggcggcgccaaagcgcgttattattgaagatcgttcagcggctattcacaggtctgaaagtccaagctcaaggttctggagactggagtgtattctctacggattcggcgtggaaagatgggttactaagcagctccagcgcactcgtatgcgccttgtcatggtcagggatagaaacaaaagctaacatgtgcttaccagaaggcgctgttcctgatgcgtatcctgtcctgcgaattcaatcatcttggtcaacatgcgcaccacaaactggacatatatcagcccaaccccaccggttccagaggccatgactccgccgcctgcaaatccagtcagtgaggcgatcgcagcttgtgcacgcgcagaggacgaccgtgccctgaactgtggtgaatgttgagtagaaccgaaaggtattgtcatcgacattgcacctccagccagaccgttggatgtgcccgtcagcaatgacactggcagattcagtgacgggttgaaggtcgatggcgctcttgcagacgatggcaaggaggtcgcggtgtatccgccaccaaggatctcagccatggattcacagagctcaagtcccgtctcgacgagcgttgacgcaagagattccatggccatccaccgttgcaaccagaaggagttcacgggcattgctttttgctgatggggaggaagtgcggtcggttctcgagcgtgctcgtcatgtccagtgtctgatccattgagtctggaggctggaatcgacgaaataaaatccatgggttcatcatggtcactcgacgcagagctgataccctgcaatgatggctcgcccgggtaatcatccgttgcatgcatgccagtcccccgatgaagataacaatcttggcacgcctcttcctcttcgcgcatctcctgaacacattgcagtaaccggctgacgttctcaaatatctccatggtcttcatgatagccccgcggctcattcctgactgtgggcgctgagggtgttgcagcagctgtgtcgactttgttgagctggcggtgctcaaatgcttcccataggggaaccccatcgaggcagtccggttagccttcgatatgtgctgcttccgcctgtggagtgcgtgcacacaatactggcctgcgagctccatccatgccgtcacgagttctgcgcagggctttcctcccagttccaagcatgacaccgacagcagcgcgccttgtaaaaccatatccatgacctcgtccacggagcggtcgctcctcagatcaggatcctgaaactcgtcctccattatgtccatctcgaatggcgatcctgcttctggtgatcgatggtgatggctgctttcaagagcaagcgtcatctcggctcggattttcactgtcagggtcagtgccagattgaggatccaatcctgggtctcttgtatgagaccctccattggcggcagtcctaatgccttccactcaagtccgtggctccgaagtgtctctccaaaaagcgttcgctgataatcgatgacctcctgtgaccgagtcaagtcttcgagcaaatcttgtggatgttgaaatcgtcccgagagcgtctcgcgcatgctctccactacctgcacgtaatgcacaatatgttcgaccgagccctcgtgaatgctccactggggacatatcctgttgatgcccatctcaaagtcaggcccgcatagccaatgggcactctccagcatcacatcgaccgctgtctggatgttgttgtagatggtcatctcctgatcttcttggcgattttgggtaaagtggtataaagctgattgctgcactggcgcggagaatcggcctcccaaggacgtgagcgcggtcaggagggcctgcgtatgagacgccatggcggactcaaacgaggctcggtccgggaacccacgcttaacagtctggctgatgatccatgactctttgtccactgtttgtgcatccactgactttgtagtggatatgattcgatgaaacagcgccaacctggtcgccatggtcagcggatggtgctgcggtgctctggcgtgacgatggtttgtcctgctttcccgcctcaggaacaagctactagaacgcgccgacgatgcgggatccaaaagtatggtaggcgaggccgtgtgcttggcaaacgactcgaacgacgttttgccgggtgtggagcttgtcgaagttgaaagtgtgtggtcccctccagaatgtgaaaagggcccaggactggacgggtgactgctcactggagtggtagggttggaacgattccctgtggcctttctgtactttctcggctcagtcagcgcggtcgatgatgtgctgctccccgaagcgtcctgtagtgagctcacatcgttcccagagagaactgaatcgggatccacagagctgtccccattgtgttcctgcacccgatagaacccacgtaaattttgaagtcctgcgtgtttgggagttgccgggtcgaggccagccgtggacggactaacatgtaggctagccgcgagacgcgctgtaaggtgatctgtcatgcgctgcgttttcgtgctcctttcagacggtggtagaggatcctttttgcgttttagcgggggagaaaaagtcgggtcgtgcggagtgggtgacgatatgggtgccgatggcaggatggcatctaaacgcgagaacgagagatagcttgcgtcaggggatgcatgtcccgcaaggttcgggcttgaggcgcaaaccaatcaactcaacgtactccttttcttcaaatcttgcccatgtgtctcccgcggccacagcgactggagatcttcgtccagcaggatgctctctgcgaacaaaattggtgttttagtgttgagcgtgggatcagcaaagtcaaaagtgcacagtcaataggcagcagttaaagtttacccatggcactgagcagcgtgttgatggcgttgctccagaccttggttggtccactcgcgcccgaccccttcataaatgtttccatggtgcgcggtcgagttgatcaaatagaggcttcgacgcttttctcactgagtgtctgtgtcgtcgtcccagtcaccttcctcccacacgacgtcaaagtcgaggtcaaagacgatgaacgagagaacagtgatgaacagtagggtcgtgggccggagcaggaccttggctagggcgagatggagcgcctggaaggagaagcgggcgtgctggcttgccacgatcctgaagagtccagcgaatggggtcgtgattggggtcgacgagacgatgccagctgttccaagtccgagaagaccgagcattgccctggctatcaggagttctatgcacttgaaggggcgggtggtgcaagaggtggagacccagaccacggagagaagtgaggatgagggcgaggcggaggctggaggtggaggtgtgcttgaggcggagctgttgaaagatgcgtttggcatggaagcggcaagaagccaaaaaaatcgaaattggcggcaacagggagaccgctttttttttttttttttttttttttggctcttccctgcctgggtgagtggcaacaaaaacacacgccatccaagcacacccacaatcgacattgcagaacacgcatcgcctgtcgtggtcgcatccatcctcacggcaatgcacaatgagcggcctcgcccacaagtccgctagggagatcaggcacagctacattcagcagtacctgggcaagttcctccgcaaagtgcatcccgacctctttttgagccacccaaaggaacagctccggaacagcgctgcactccaggacctcctccccttggtgggacacaacaagcacaaagacaaccacagccttccacgagcagctggcccatccacctccgacaacacagccaccaagaagctcgtcttttattacaagcctgggccagggcatgcttctcctcaacaacttgcagccgtcagtccgtcacaggccacgtcgagcggatccgaggtgggaggatcgacggccttacgatccgtggagcacacgctaccgatagtcgataccagtataccctcagttggcactgcacccatggatgcacaacagcatgcgctggagcaagagatcaaatcatggcagatggtgcagtcctttctagacctctgtcgcaaagttgaggtctccgttaagacgcaggatcaggagagtgtcgcgagccatctgaagcagtccgtcaaagatgcagccatgttgcaatcaaaacagcaaagaaacgggtcggtgccgcaaagacccctttccgagatatttgctgaggagcttcagacgtcgttctccggatccacagggacctcggcgccacgaccacatcgagcagcagctacagctgaagcacaagaagatatcagccaggcacacttgggaaagatgggtggatctgcacctctgctggacgcgcgattgatgatccagtcgaacccgttactgttcaagagtcccgcgctatccaccgcaaagctgaacaagttgatccgcacctggattcactggcagcacgaggatcggcacatcgaagagtctctgcccaatggcagtatacaaagggagaaggccttccgcttgggcgagtggtggcgcaaagtgccagtaatgatcctcagctctggcgaggaacgggctgagctactcaagaccagagtcggccgcagtaatggacaatcggtccagggtatgttggtggtcgatcaggagatgtcgaagcaaggtaacgtggctaagtcttgatgggccgacgcgatacttttgcgattgtaaagggctatgtatttttaacaagagacatgtttacgaaattactctggatctgctgcggcggaacttagatatggtgcgctatctcaatagcagccttgctcgaattcagcgagagtaccaagatatattgcgggcagccaattgtgcaccgtcaggagccaacacggcccctccctctgtgtcgcgcccggcccaaccactgtctgcggaggcagcttcgtcgtatctggagcgcatgagggcgcggtcattggcgaagggagcaagcaccagtcggaggagatagccccccgatcctgaaggtggcccaagcaagtgcttgtatgaaaatgtggtaaattgggtgtaagcaagaacgaagctccaagcacgggtccggggcgaaagttattcccagagtcgacgtgctgcgatgatgcgcacacacacaaacacagggatccccctgtgaaagccactcttccatggaaagtacacgagaaagtgagagcactgcatcatcgctagagttgtaatcactcgcacagaggacacgaaaataaaaaagaaaaaagaaaaaaaactttaaatcaggtctccgccccccctgcctcaggtgggccgttggagcttggggctgcgactgactcccgggacgaaggcactgcgtctgcactgggctggccaggactggacggggactggacggggagcaccagggaagcaccagggaaagaagtgcgactgtgccgacatacggtctgaacacaggcccgcctgtccaccagtacaaatagggcccatgtttcatttccacttttatttttttcttctttttctcttttcacactcacgttttcttcttctcgcacaccagctttcgacccgcccgttcgaatccacgccagaacgcacatcgcaccagccccatcgcaaccccaagcaccctccttgcccccacccacctttgaatggccgacgaccacccccccatcctgccgcccaatgccaacagcccagtagtcaacaagcgcttgtcctttgcgaacgacctgcacgacggcgccatcgatgcagtcgcaggccccaccgctccctcgaccgtcgagggatactcgatctactcgaacatcaaggacggcaaggtaaccacagacacagcctctgctcttcaggagtggagcagacgcactcgagtcggactggacttgacgtgtggttgagtctactgtatgttggtgtacatacagcacgtagctgactgagaacctcctgtcttttcctctttctatcttttttctctctaccgcgattctatttcctctttcatatactcttaggccagtatcgagcaccagatcgagattaatggtacgtcaaagtgacgagtcggggatccgagagacacctgtcgtattgtgtagaccgacatgcataatgcctgcatgacagtcaactctattccccgcgaaaaaaaaaaatgttgtgcgtatttgggttacttatgaaaaaagtcgttctactctatttttatacgacctcgttcaccatcgcagtcgtcgacctgttcgatgtccagagcaataaggaaatctcgctggaggaggtcatggacggcctccgctacgtgatggagtaccgcatcaagggcggccgattccccagtctcgagtacgacatcatgaaacgtctggccgatggtctgctcatgaacatgggcaacatcgaaaagaagggcaccttccgccacgctctgtccgaggaggcagacgttgccttccagctttttggagaattcctcttggaaggtacagcacaacacgcgcttgtgaaaataccgttgagaatgtcacggatgatgattgactgataagctgccttttttgtgcgtcctttcctttccaatagtccaagagtttcgacaggctgtaggtgaaaagcccgtctcggatcttcgtcatgctctcaagctggatgtgcgctgcggcccaggatcgaccgtgcaggagcagcaatccgccgtggccttgatcgctctcttgacgacgtactatcctcagtttgcagactggaaggaattggtcaaaagcgaaggccagagcgccgttcaaaagtgcatgcgcgagcatgccgattacgtcaaggccgagaagatgccagagatgggcggtgtcattctcgctcctcaagccctttgcttcgaccgacggataaagcgctgtctcaagatgtaccgcacgtccttggaaactggattgccctcggaggccatccccgcgttgcaggagcattacggaaagaacattctgcccgaacccccgaaaacgtcaatattcaaaatgctctggacccagtttacagactttatgatcttgctgctcttggccgttgccatcctcatgggtgcgacaaaggaatacatttctatggcagtccttttgatcgtcgtcgtgctcaatgccattatcggattcacgcaagagtacaaggcaggaaaggccttggatgccctgaccaagctctctgtccccgtcgcccaggtccttcgtgatggagcaacatccatgatcaactctcaggagctcgtccccggtgacattgttatcttggaggagggcgagtccgttcctgcagatctgcgtctcgcggaggtctctcagctcgagattatcgagtctatcctgacaggagagtctgtggctgtgaccaaagaccccaaagagatcaagaccctgacccgcaagctgcctctgggagactgcaagggcaacgctttcatggcgaccgtggtcgcgaaaggccgtggtaaaggtattgtcgtccgaacgggtcgccagactgagatgggcaagatcagtgccgctattacgggccacaaaaaggctttgacgcccgtgcagcgcaagctcgccatgcttggaaaacttctggtctgctttgcaatcgtgctctgtgccctcatggcattgatcatgattgtaggatacaaaaatgaggtgaaatattcattgcagcttgccttgaggtaagaaaccacaagctatcactccttttgagatgaacctgatagtaaccattgcttagcatacttatattgtccgctctctctctcacacacacaaactttctttattttcgctggatcttagtctggctgtctctgtcattcccgaaggtctggtcgctgtcgttacggtgacaatggctcttggagtgcgtcgcatggcagagagaaaggcaatcgtccgtactctacccgctgtcgagactttgggaagtgtcacctttatttgttccgataaaactggtaccctcaccgagggtaaaatgggcgcagcacagctttggacgagcgatggagttacctatggcttcactgagagtactagcttggatcccaacaagggtgacgtgaccctcacgacaaactctcaggagacaccccaggttcttggcaagactctcgaccaggtcccggcccagatgctcatttctctcatggtgtcgtcgctctgtaacaattcatcggttgttcaaaaagagtcagacgaagattcgacaggtcccgaagcatcagttcccattcctgaggactctcaacaggaggagaaggtccctgaacccgcatccgacgctatcgagtggaaaggagtcggagatcccaccgaggtcgctctagtcgtcgccgcacaaaaggcaggattcccgaagtcctttttccacgacatgggatatactcgtatctatgagcaggcctttgacagcgagaggaaagtcatgagtgtcgtttacaaggcaccattggaggagtcagggcatttcgagtttgttctggctaaaggagcacctgaggaaattctggaccggtgtatcggacacctccctatggtcacgcctgacgccgttagctcaccgttggatcttttgaagccaagcgaaaaagatctctcgcagccgatcacggaagaggtctacgactatgtctcacaggctgcaggcaagatggctgacgacggtcttcgcgtcctaggactcgcatacaaaaaagtcaaggtcaatggaggcggtgccttgggcgaaagtgttggcgatggactggaccacgtcaacaaaatcaagggcgaaaaggaggcggcgccatcaacgtacaaacccacggacgtggatctcatgacggcagcgaacgttactgctcaaggcgacgatgacgatgatgacgaagaggtcccaccagggtatgctgaaaacgactttgtatttttgggtctgatcggtttgatcgaccctgctcgtccaggagtcagggagagtgtgcggatatgtaaagaggctggaatcaccgtcgtcatgatcactggagatcacatcaagactgccagtgccattgccaaggagctgggaattctcgaggagggtggacgtgccatcaagggcgaggaactggacctcttgtcggagcaagccatcgccgaactgaagccgttccccaacgtctttgctcgtgtctctcctgacaacaaactcaagctggtgaccgcgctgcaaagcaggggcgcctctgttgccatgacgggtgacggtgtgaacggtaagtgtacaattttgcgctttagtggtgatatgtagtggaattctggagaaagcaggcttgagctggagaactgatttgttgccatccttgttcattagatgcgcctgctatcaaggccgccaacgtaggagtggccatgggtattgcgggaacagatatcaccaagcaggcagcggatattgtgttggcgaacgataacttcaacaccattgttgaggctgtgcgggagggacgtcgtgtctttgacaacatcctcaagtttatcgtgtatcttctgagctgtaattgtgccgagattttcttgttcgtactctgtgcaagtgtgaactaccatgtgccgttcgaggtgatcatgattctgtgggccaatattatcggtaagtgcgattatggccatgagtccttgccactttatttgtgcacttctttcgaacccgttctcatcaatgtcctttcttctttcactgtacctcatcaacagccgatgttcctccggccatggccctgggtgtcgaacctgaagaaccaggcctgatgacccgcgcccctcgatcggccaatcgcggtattctcacgcgcacgtccattagtgtcatcctcttccagtccatggcaatgatgcttatgaccttcggagtctactcctgggcagatcgatctgagccgaacttgagatacgcacagtccgaggcgtttgcgttcttgacaacccttcagcttttgcagggattcctctcgaggaccatgcgcacgtctgtgttccggaccaacttgttgagcaatcggtatatgatttacggtgtcttgatcagctttgtgctcttgctcattggtctgtacacgccaaaattcaacaccgagatcctgaagctggagcccgtgtatggtttgacctgggccaaggttgcggttgggtgcgtcatcttgacaacgctcagcgagctggagaagttggttcttcgtcacactggatggaccatctaagcagcacacatatcccactactatctgagagtgacataccaccatcgcaagaagcgaacaaataatttgtacatagcacagccgtgaggaggaccgattgagggaaaaagcgcgataggaagcgtgtgcactccccccttcgatggttcgcatccccttagtggctcttcgtaataaaatacaacttgcggtggaaactcgaaactcattctctttttccttcacggggggtttttttataaatatgatctaaatgcaaaaaagcgagttctatgtaagattgtccaactcacagtgggccctccaaggtcctgagcaggatgttttcgaccttggccagctgctcccgcgtcgagacctgggaggcgatcatgtacacgacattgcccaagggccgtccaaagatggccacctcggtctcgctctcctgctcacccttctcgcgcatcttttgctggaccctttgcgagagcatggaggcgtatccagagggaccgtccgtctcgcgcaactggatcgcgagcacgcttccgagcgggaccacgccctgaacgatctcgagccgagagatcctgtcgacgaccttttggtcccaaagactccacacgcccaagctgccatgggagagggcgccccagtcctcacgggcctggtctgcatcgccatgggattccatctcgcggtaggtttggagggaggtgttggcgaccgcacagccgatcgggtgggctgtgtacgagtgtccgtggaggagggcatcggtcttggtgtcgctcaagaagttgttgaagatgggttctgtggtgagggtggtggccagggtgatcaggcctcccgtcagcaacttggcatacgcagcgatatctggtttctgtggcgaaaaaaaggaagaaactggttagaatagacaagatctcgggatcggtggtagcgaatccaaaacatcgagatggtgggggacaaagtggagaactttaccacttgaagcatgtcagccgcagacttgcgtcccagacgccagcagccactgaagacctcgtcaaagaccacaggcaggccggaccagtcgtgggtcggaccctggctcttgtcctcataggatggctcgaccgttccaaagcccttgaaggccctgacttcctccaccagacatctttggaaggctgggtcgacccagaccatgcctccagcgcccatgagaacgggctccatcagcaaggcaccaaactgtcggttctcatccttggtcaagcgtgttaacgtgcttcggatgtgatttctataaatcgccaggcgggggtcgctctccgatggctttgcaaagaccgatgacaagttgttgatcgtgaccttgagcgttttttgttcagcactaccaccaccacccctcacatccgcagtcatctcttgtgggatcgtgatctggaatgtagagtccttgtagacaacagtgggcggggtgaaccagtgaccatgggacttgtaccagctcacctgggcattgtaggcattgggcgaacaggcgttcatggccccgatcgtatcgccatggtatcctccatcgataccaatcacctcgatcctccggttggtgttctggcccatgtggacgtatcggtcctgggtcgatttgagggccatcttcagtgccacctcaatcgcggtgcttccattgtcggaaaagaagacgcgcgatgcccagtcctgaccgacggtctcgaggagcgtctccgacaacttgacggctggctcatgcgcacactcggggaacatgacatggccatagcgtccggccgcataggctgcggatcgggtcagttcaggcgatccatggcccagtccctgagtccaccaactggcacatccatcaaacatctctctccaacgccactccttgtccttgttgtccttgttgctgttgttgttgctgttgttgttatcccctgtggcggtcatggcattcttggagggttcgacgtaggtcgtcatgatatctccatacgcagaatcaatgatcgtgacatccttcacagtctggtgctgcgtaaacggccaccagatcttggtcctcgccttctcgcccagttcctcgagtcggtccaaccgtcgttgatgcgccctgtccagatcttcgaccacgtcccggaaataactctcggtcctcttgtaatactcgtgcaattgctccgcatccgctttcggatccgccaacttttcgggtggtgatgggagaacgtgcaccaacggccggttctcggccttggccaggtacttgtccaggaactcgtgattcctggagtggttgtggaagaggaggaccgctgggatgtcgtagccgtactggtgcaatgactcgtaagaactcaaggtggtcgagatccctcccaaatggctgtcgcctacaagcactgtgggcaagcgcagcgggcgataaaacctggattgaagttctccagacatgatggggctgttgacacctacggatgcatcacagtcaatcatattagatttgtgaattgcgtgtgccatggacggggctggagggggggggggaacgcaagtgagaagaacgtggttgaaaaacaagaagtgaccgtgtacctccagctgtttccagaagcgcccatcccttgtcgccatgctcgaggctctgcttaaacccgcgcagggctttgatggtcgcttgaaggacctccgtgtctggcggcggctagaaagaaaaaacattgggcaaaaaaaataaaaacgagtgagatactggtgggggtagggtgacggcgcgaggtaggtcgcgccattgaaaaatgcaaaaatgcaaaaaaaaaaagtagacagccagtcctctgctggggttactgaacgacgcaagtgtggggtttgagcaggccaccaaagatccttcatacctccgtggtcgcgatgtgagggctgacgggatcgggataggcgtacaaccggctggtctccacaagtggggcgtatgtcttgacgtgtctagtgcacagcccgaggcacgttaaagaagaaaaacgaggtgagcggctcactttcctattcgcagtctttgtcattcgcgggtgggatctccattggtcttcgaatgcgcacagggggtctcgtcttcatttctcttcattcttttttgttggttttacctggcgtcacaatcaaccgggtagccggtctggactggcttgaggtagaaggccttcatcctcttcttctccgcgccgatagccagggcggcggcggccctgacgaggcccgtggagaggatggtcttgccaacgttggtgttggcggcaaagacctggtgtgcctggaacgacctcgtgggaagatgcgccatgagagtgagaggggagggggacggagcagtgcaggatcggaggacgaaaacgggcgagagagagagagggagagaaaagagacaggaacgaaggttttctggggtgtgcttttttttttgttcatcaaccttgatctcgccgcacgtattcaattatcaaagatctgagtgaaaaccgtacgcaaataattacatttttcatttttctagccgtaagtggccatgggggctgcgatcgggaagatgttgacgatggggaggttgttgtacgacagccgtgcgctcgcaagctccgctttcgtgagcttcctttgaataaaccaagcgctgagctgcacgacccgatctcctggatccaagtgcgcgtcctcctctaccgtggacgataaaggcgacaaacgctcgtcctcctggatccagtcaagtagcagctgaccctcggaatggcccaccatcaccacatggatatcaatggcatcctcctggataccctctccaatctgcatggggtccgcggtgcctgacgtgctgccctcgtttgagggactgggttgagggttggcggagctggacatggcgaacgtggtctcgtcagagttgatgatcactattcccttcgcaccagccacctgcgcgtaatacgccttgaggatgaacagacaggatccgcggtccacgacgagtatcgtgtcctggatactgcgagactgggagaccgtaaatggacggcatcccctttcgtttccgcgaatgcggatcaatctctttgcgggaacacgtcgtcctgtcgattgtacgtgtggaatgtccgatcccatggggtgctgttggttgtcaccctgtcgctgctgcgatggcggagccatgtcatccagttgctcctccgatggcgcctggtgcgattgaggacgagaacgatcctcttcgtaatccaggacgctaggtcgccagtatccaaaatccgcgggtttgatcaaaaaatcctttagcagcacgtctgcatcaagcagcgtgggggcagagctcttgtaaagtcgcaagtgagcatcctgtgatcgctggtaagtatcccaaagcggcttcatcgatgaatggtcgacatacacattgctgttgagactgaggggatggtccgcaactagttcaacgaaatcaatgagcacggtcaggaagggcgtcgaacttcacactgtgataattggcgtcgttcaatgcttcaacatacccttgatggcacgatatccattgttgacatcgtcgtactgaagctgcatcttcacgcccacgatccggttcacaaacacacccttcttgaatggaatcaccaggagctccttcttttcgtcggctccacttttttcgaacgcctgctttccgccgtcgtcatcgctgtcgcccaagttgtcgtcctgaaacacggtcttcttgggcgggcctgcgaactctacgacaactcgctcgacctctagcgtaggcttttcgcaatatccctttggatcaagttccacaatgtctcgcgcatcctcgcgcacgcccaccatctgcctcgcaaaatccgcatcgggtcggtaacgtatcgtctttaaaaacgtttcgggcgcgcgataagctcgacaggtcaacgcagactgagcctttccctctcctgcagacgaataggtgtgttgctgtgggcgtggatactgatgacgcggagtcgtgccactagaacgcctcgtgtgagcgactttgttcctgtccttgtccaagtactttgtctccaagccgaggacgtgcccctcagttgtaaaaacgaaattggtgtccttgagcccttggtgtagtacattttcttcgtcatagagtaggaagaggtatttgaatgtctcggacagagcaaagctttccatcctatcctccaaggatttgtcgataacactctgtaaggatgaccacccgcacttggtcctggtatatgtttggaggtcgcgaaggatcatttcgccaacctccaggtaaaatgggtctttggtggcctgttaaaagaacaaacgcatgcgttagaaggcacccagatccaaacaactagataacagatgatctcagtgtcaagctattgacgcttaccctgtagaggaagtaattggactcgacaaactctgggcggaggggatagttggtaatgtccacagcctgggttacaaagttgaaccgctcaggaatggcttggtatttgcgccagatattgtaatagtacagatggttcttgatcgcgctttccaaatccccacccagcacctgcaaggcagagaaagaaagcgttgatattcgtgtaaaaaatgactgaatgagtgatctaaagacatattcagtgtacattgcacagatatgtcaaccgcagaaaccaatgcgtacctggacgcctggcatgaaggccgatagactgtcgacccatgttgccatgagactgccatcctcgatgtgaacgtgcttgtaaaagtatttggagtcgtgtagcagattgtgtcgaatggactcctgtgcggactcgtacatgtccaagtaggtgttgtctccaaagagcacgtacgactttaagagatactcatagaaggaatctgtgcccgcaccgattcctgtcatcgcagacatccattgtcccgtcgtgatgttgatagtgttgcctacaagaccgatcttggaccgcctgtcccaaagctcaaaaagagctgttttggctgcttcctatgctcggttgaaagaaaaaaaaaaaaaaaagtcagacgtgtttacttaaccaactctcaaacagacccctgcgcatcacagcgggcacttgcattgtcttacctcgtatgtcttgtcgcctgtccatctgctaagcacgccaaattccaataacaagctgccagcgcctgctacacaagtctctgatgactcgtcccgcaaaacgcccttcttgaggttcaccctgggccatgggatccccgtcggtgtattttcaaaagccctcaacagtctcttgccaagatcctcggccatgctcagcagttcgcccctgtagcccttgacaatgctaccgtaacggggatccgacgcatacatatgtcctgagagcagtgcgcccaagattctgatgttgacctcaaacacctggacgcggctatcaatattgaagtttcccacatgtcgcttgaccagctgaatcgccttctggaactcttcgggctctctcatcaccgctagagtgtcaagagcgtcgatcatggtgagcgaaaagtctccaaggacatcattgatgttgatgttgttggggttccgtcgatctggtcctcgaccgctacaggtgacagggttgagttcgtccttggggaatgcgtggtggaggtagccatgatatccatgcatgaacatttctttggcctcgttacgaagaaggatcctccgagcctccgtcatacgctcggtgacgatctttcctggagcgctggctgtgtcggtgatcggaggaagctggcgaaagtatggttgagggttgactcttgccccttcgtcctgccctgctctcgcactgttcccgcttccgccgttgctcgacccagcctggttagaggatgcattcacgccgttgttcggaaaggttgcagagaacagaatttgaaaaaccgagaacacaaagatgaggagccagggtttgatgctggcattggctaaagcattgttgtcattgttgccgttgctgctgctgttgctgttgctgttgctgttcctgctgttgagctggttgagccgattgctactcgctgtagtctctgagttgtgaagaggcgcttgcggttgctgctgctccgaagaatctggctgtgcatcagaggccatcgagccttgagatcccgcacagctgccggctaagtccaaggtctcctcatctgctgatgggtctgaggcgagtcctctccgttgtgctgccagagagccattgccctctggacgcttgggcgatgcagagctggctgtgcgtggcatcgttggcggactggccagaccgtgggtggggaagtgatgggctgaggtgcgatggtgtgtgggtggaaagagtgccacagctgcgccggtcttggatggccaaaaaatccaaaaaacagctttcattgcctctgtgccaagtgcatctgcgcatctgctgcaggcccgttttgaccgagtccacgccctctatgccgtatacacaaccgccatccgcggggcgacaatagctcaccataacaaaacctttatgcaatgccttctagtcgacgtatatcataagcttgccaccgctgcgatcaatcgcttcgcgaatatcggcatcgttctggatcgttgcaaaatcgcctcggtcatcgcggtaactcaagtccttttcctccgcattcaagcgctcgaaaatcttttgctgtaaggaacggaacgtgatcgacacgggtatcctcatggccatgatgtcttcctggtacgaaatcttgagcttgatcatctcctctgtgctaccgctgaccgataagggacccgacgtcgggaaagaggcctgcgagcgcaggcttggagaagcgtttgcggaagctggctcgtcggcatggccgcggtaaccactagaaagtccctgctgagattttgttccgtagactgcacgaggtcccgatggcgagggacgccggtcggcatgatgcgctggagagggtggtgcaaacatgctgcttgtgggtgtagagcggcccgctgacggcgaggacgatcgatgaccgcctgcactcaatggcgtttctgtatccccctctcggacagcaaagagtctctccaccaacgggtgctgcatgatcctcgtgggcaatctgcacaaatcctggacgtagccgtccagatctgccctacgggacgccgagacggtgtcgttgactacctgaagcgggatgggcataaatggcagaatccggggctggtctccgacccttccagattctacaggaaactcctcgagaagagcaatatgaaagttgtagaaatcctcgtaaaggcggaataaattccgcgtggtgcctgaggcgagctccacccggacagtgaaccagtaatgctcatcctcaagatggaatgactctacagacgcgttgacgatttgcagagggtcgacatcctgactgttatgcttatagttctcgaagccgtctccgttgccgttgctcctaattgatcctgtgcctgtacttcttacactggcgacatcctcacggccggtctgtttgaatcgagatgggcaagattaatgggcgataattcttgcatggagccgtcgaccaatcacgtctagtcaaactgtccttaccatgcgtcgaccagcatcaaaatcttgagaaggcagtctctgcactgctggatctcgctgctgggatttaagatctcttgacatcttattcttgagttgctggattgttggtccggtgttgtggccaggctgttgctgctgcaagaactgttgagggtttatgggctgctgctgcgcatgcatgctatggttggcttgatgatgatgatatgactggtggtgttgctgttgctgctgatgatgatgaagctgcagttgttgctgctgttgttgctgctgttgctgctgctgctgttgctgttgctgttgttgttgctgttgctgctgaagcgcctcattggcgtcgattcggcccaaggggatgctctttgctttgtattccatggcctgcttcttccattcctcaacacgaggaatagccgttccagtctgtcgaagcatctctgggacgttgatcggatttccggtgaccatatctctgatttcgataaaactgactggaatcaaccctgggccgcccagtctgccgataggcttggcaacataccactcgtcattggactgggcaatgactaggatggcgtcccctcttttcgcgtccagctcgtcgggtctctctgctccaaagtcgtacagtacgataccgtacaatggctgacacttgggcaacggcttctgggctggtaccggtgcagacaccgcacctccgttggcgcctggctgtggatgatgactgtgctgactatgctgatgctgatattgctgctgttgctgttgctgctgttgctgctggccgtggttatgggcaggaataggatccgtgaaagagcccgagtcattccccgcgtcctcgagactctggctgctgttccgttggctcttttccaaaatctgaaaatacgtgacagggacgaatccacgggcgccggttactgggttgcaggcctcataccagtcctcgtcgtcctcgttcccgacaacgtggaagaagtcgcccttggcgaaagatagctcctcgctctgctgagagttgtagtcgtagagagccttgatgaccttgcggggcggggccagggccgctggggcacgaccgggggcgagtcctccagagctgctcttgttttggagagatcgtcgaaggttttgcattggacaaaagagtcgggtggtgctgatgatcgcctaagaaacgaccgcagagaggtggtgagtggcggctgttgatagcagtgagcagtgttggcggagtgagggtccaacggcggtgggtctcgaggcgcactgtcggtcaagggatgagtaatcagcagtgggcgtggaacagcgtgagagaggaagcaaacaacaagaaacaaaaaaaaactatgcggaaggagagcgagagagagggtgtgtgtggtgtgtgtgtgggatcgtacctgtgtaaagaggtagagaagcgaggcagccgaggggaggagagggccaagagagttgagagagagtcgagagagtcgagagagtagagagagtaaagaggcagaggggaagcaaagtgaggtaaagagaggtcaagagaggtcaagagaggcaacgagaagtgtgaggcgaggaacagtgaagaagagcgtgaggacagcagacagcagagaacaacaggggcagcaagggggtgggggcaacaaacacaacacccaggggacgccaggatcggattcgctgttgcctctggccatccccaccgcccttggcccatccatgtccaggccatcccctcgtcgaccgcccatgtcgccattcatcctccagccccgaggagagacagcgacagcgggaggccgccgtctgcttatcacatccagaccggcgtactgatcgctcagtactgttactgtgtatacatgtacagggaacagccccaggaggcacaatttcgagtccttgtcttttcgtttctttctgggaggttcgatcgctggatacaagcctgtgcatgtcggttgatgtcggttgggtgggcaggaggatggtggtgttgctcacccacctctgttaggtgcggaccacacactctttcacacatcctctcctctctttctctttctctcgcgcgctctctcttcctcaggcacacgcacacacacacacagacctttcgtcgcagctccttgaccagcagcccctcgccacatctatcccctgtttggttcaagtgctctcctgtggctcctctttaccctgcttcaatagcttcgcagctgtcacgtcttcaccatgatagatccctttagcatcttctttagatcacagaaaagccccaaagttcaaaaagtgctctcgaactcttgcgcccgtagattaatgtgcctctgtgctctcgagccctgagagcaaggttgaacttgttcccaccacggatcctgtccccccgcagccgccctccagccacgtcatgtccacgatgctggcgtgaacgtctcggcaccgttaaaccacacgttgaaacatcaatatacgtgatccctcattcccccttcctctctctctctctctctccctctctctctcttctcgaaaaaaaagatcgtccgcggcagactggtctaggctcgccgtgctgcggcttaacgagtgaggctagagcgatagagtcatggacgtggttctttggggtcttgaagtaaacgtaagaggtcaccaccatatgccgtaaagataagacgacaggcaccaagacatttccgttgttcgagagtacaaagttttttttttttttttggctggtggaaaaagcgagtgcgacgagtgggtcgcccatgtggaagttgttttgacaatccacgccgccgtgtgtgtgtgtgtgacaaagcaattattattgggggttgaaggggcccgtccatgggctatgctgcggggctggaggtggaagcagccgccctggcaagaaggggtcgccagctaaacgcgaaaacggcggccttagcctatccccagccccacccgtttgcccaacgtcctatactcttggcaaaagtgagatccgcccaaaggacttgctcccagctcctgcaggagctgattatgattgcacttttcccctccatgctggccgtatggtctcgttcgagcgtctttgctagtgctgctggacaaatcatacggatcctgaatgaatgttggtgtccaataggtcagatctgcgatctgtccgttgctgatcgtggggcactgcaacgagggcgagtgcccaaagcgccccttttcgtcttggcctttctgggctgtgcacttgtccagacgaccggatgagctgaaactttccgtaggccgtgtttgggcttatattcagctatgccatggagggctgtgtatgctctgtcgtctggtgtccaatgtggagcgttttcaccaggggctccatacgaggagaacagcccgggaatgcacgtcgctctggattatccgcgaccttgccaatggagtctcttaaatacgacgacgccacgcgcaaaagaaagtcgactgacaaattcgatttcactctttacttctcgacttcaactcttctcttcacttttctttgcgcctccccctcgctctttgcccactgcctaccactcatcgctccattcgcctgccgattcccacctttgcattccattcacaatgtccgctctcacagacgaccaaattgcggagctcatcacccaatccctcgaaggtgagcggcgccgagcttgttgtcagtgtatctgttgttcgccagctcctccccgcgccctcaggcacacctaaacaaatcaacgcacccaagggtgtgcctcccacgactgcaaacaacaccaaagcactgactctcatgcctggtcttcctactttgctctccgtagccaggaaattctcttactctccatactcaaagttccgtgtaggagccgccctgcgcacggtggacggcaaaatctttcaaggtaggtcaagcaacaaaaggcggttgggcgtgtggtcagagatgattagactgttgacaaagacatggctgtggtacatcttttctcatattaggttgtaatgttgagaatgcctcttatggtaaagaatgcagcagatgcaataacgtgcaacaacagatgagccagacgacggtctgaaagagatgtacacgaactgatgcccattttttttctctcttgtgatatttgctgctgtgtgtcgtgtcctctatattatctgtgctgttcaatgcggtgcttaggaggagccatctgcgccgaacgaacggcattcgtcaaggcagttgtaagtagtgtcgttgcaattttttttttgtggataatattgtgcccagaataatttggaacgtcaagatcgggcaaacctcatcggagaaagcgcgcgcgctctatcgcaaatcccaaagaaggggcaatttttttttcggtataactgacttgcgtctcctctcgcgttcgaaattgttatttctagagcgaaggccaccggcggtttgttgctattggagtatcctggtaaatagttcagcctgaagccttcccctacagtcccccgactgcagtaatgtgtggcatattgacctgagaagcagaaaactacttgatcccgcgcacctgcgtatgtccccatgtcggccacgcggcgtgttttcaaacttctatcccactcatctgggcttggccaatcacctcacgttactttcttacctgaatgaattactgatcgaaacacgacaactttctttttttttcataccaatccagtgacttcaaccactttatcaccccatgcggcatctgcaggtgggtgcagctcgatgcggctctcagcggtggctcctgcttgttctaaatctggttatcctgatactcatccactccacttgctccacttgctccactcgtcgctaatatagacaatttatgaacgagtttggcaagaacctggagatctttttcgtaaatgacgacaggacgtacaggcgagcagtgctggcagatctgctgccgttcgcttttggcccagaggatctcccagataaataagtgcggcggcctccagagcaacgactcgccgtacaaaggaagagttcttttagacgtgaacagacatggattaaacgattgtcgcgaagcaaagtgttatggggactttttttttcggcgtatagagacatcccgatgagtgtatgatctaaagacttcctagtctcagtcgggatcgctctcacgacggaccaagcattggaaaagcacgcaggtgactggaccttcatggacacatggaacggaaaaaaaaagtttgttttttaccgctcggaggttactgatgacctcaaacctcatgcatgagtccctgatccccgactgcaactgctcacagtcgctcactgcttctttctatctttgttcatgtcgttcgcgcttctctgctcagttgatgaccctcccaccatctcctcccagccatcccttgactccgcgatcgagagaggagggattacctatgggatccacaaagaaacaagaaaaaaaagtgtacaccgatgagaggccatcagtgtaaaagggatgttcggttcttgcatgcgagtatggcagcatggagtgcgtgggcggctcgattgaatcggacaaggatgggtgatagtgtgggtgatagtgttggtaggtcctcggtctcttcctttaactcggaccaagaaccaagggatgggatcgagaatcgagacaacatggccaggtacagaagatgtatgtacatgtacatgcacggtagcgccccgccgttttgttctttggatggtttgtctagtgtgtgcgagatatatatgtgccagtgcatatggaagtagaggcgggaagcaaaggcacagacgagtgaaaaaggagcgagcggatgcttaggcaaaaggcgagtagccatgtggcatgggctcgaggctcgggagggcgataccgcccatgcagagtgcctgtttgtgtacattattagacgatagactgagcgtagtctgtcgagcatggctgtcccttggtcatgacccacaccaatgggtcgctgcagactgggaagaagggggagggcagagaggagagcgaggtgcgtgaggaggcaagagggtgctaaagcgcgcgctgtcctgtatctgtagtgtgtgctggacctgagactgataccagttgctctgaatctttttttttcctgaatatatccgcgtgcagatccaccaacaggctacagcaccatgggcccaagagcgacgacggaaagacacaccataacagcagcactctttagccatgcccatggtgccttgatttagtttttttttatttttctttactttatttttattctcaatcccacctgccctccatcctcctgttccgcatccaccagcacccaccagcacctcacacccaacgcacgctggtattttcagtcactcgtcctcgcgccatcgcagcctgcccccatcctccatccacactcactcactcgctcattcactcactctgtcactctcgctctggcccatccctccagcccgccagccccgcatcctccctcccttccactggcacactcgcccaactcgtcatcgtcggttgccctcctcgagccccttgaatcccgacctcagagtttcaatcgcccctgtgcacgctgcaacctcttcttacggtcctcttgcaccacctctcccgcccccttcccagcgactttaaataacgtctgactgcccccaacctcccctcctcggcaccttggccgccccgccagctgactcctctggcaatggacgaactccaggcaaagctgaccaggtcagctgagctcaccgccgccagcgacttcaaggtaacaacagggccgcaaaccgtgaacaggaggttgccatggcgcgggcaaaggcgggcagcagtgggggaatggatgcaatcccaggatagcacagcgcccacgagtacgtacccaacactactacgcgagggctcgagtcagcgagccgagaaaggcagagcttaatgtagaggagacaggaatattcggcggttggaggctgataaaggagaggtcttaactgcctttacctgcccacagtgttgcataaatcctgtattgacccagtgtgatgtgtgctctaggacgcgtacttgaactacctcgaggtcctcgaggccaccgccattgagctgcgaaagatcaagtttatccgcaacggtgagtagaggcacccaaaagagcgaatccatgaaagaactgtggacctggaccaagatggcttacccgagtgatattaccttctttgtctttcgggaccttgcaacagtggccattacttcaaagtccacagtgtcgctgatctccatcgcccgcagcagcatggcatccgcgcaggatatcctggcccggcacaatgctgacatcgcctccatctccgaaccactgcctgcgagtcctaacaacagaaaaacgtccctgtccagacacaccgagagactcaattcgggggaggcacgcagtgtgaccatgctgacggagcaactgcaggctgctgccgcggccgcaagggcgagcacaacaccgacccccgcaaactcgccctcacccagctcgacggcagaccatgtcagcaaagacgatacctgcacacctcctcctcgtccaacctcttcctcgtccacaggcaccaccacccccgttactcattcaccactcctccgcgcagccagcagccatagcatcaccccgcccaaacccacccgtcggccaccaccctcgccccagtcagaaagtcctgttttgctgtctcctccagagatggataccattgacgaggagcagcttcaacccgttcgcaacagcattgagatggatatgattctgttgcagcatccggaaagtcacagcccccccaaggaagaacaacagcacaccgacgtcgaaaccacacccttgacagggccacctctgcctccaaaaccagtacatctcattagaaacctctcagaaacacggatatctgaagagctatcgcttgacgaggacgactcggatgacgacgaagacgatcacgatcaggatttggtgccaggtaatggctattggcgttttatgaatggtaaagagctctcaagtagatccgtagctgaccgagacttgtcccactatagcagaggagccctcccaccagttacatcgaaagacatcttcgcctagtatcgccataccgacaacaaggaggaggccaggcccttcagcatccgtgcctgcttctccaagtcactcgccaacgaatgtcgcctcaagctgcccttcccctcaagcctcgcgttcattttcacagacacgctaccagctcctgagacaaagcagtgcaggcgccatgatttccatcataccagagggttgcgtcgaccccaccagtcttgtggaggcggagcgcatcaatggcgacgatgaggaccagctcgacttgaagacctatggcccctcggaccacttgccgttaattcctatttcacccctccggacgtctcatcggactcttctggaaaaggaaaagtcttggtcttccatgctcatggacgccaaacacaaactacaggcgcgacagatccatgcgcagcacgatacccatactggcgaggagcagcgtctggaagaagatgccgagacacaagagctacaggacgatctgcgaaagtacacattacagattggcaatgtgatggcgaccatcaccaaagtgcgcgacctcctctaccggtccgcgagtatcacctccatccttgagtttccaccatacttggtagcgtatcaactgacgctcgtggaatcagccatctttctggaaatccctccagccgcactattgacccactcgcctaaatcgccgcatgcaaggataacggcgtcaacggacttcttcaactatttgacccgcatgattgagcactcgattctatttcctccagaggcgtctgggcgggcgcagagcatgaaccattggatcaaggtcgctgtcaagttgcatgagctcatgaattttcagacattgaaggcagtgctctcggcccttggcacaccacccatcaaacggctcaagcgtacttggagctttttacccagaaagagcgccaataagctggagatgctctcggagctgatgagcgagagcaggaattacggcaaataccgggagatgatgaacagtctatgggcaggagccgttctttcctcccccgaggcaacctcgcccattctcccagactctagctcagcgatatcgggaagccgtttcgacatcctcggcagctggagtagctctgatatcaaagccaaggagcccatcaggatgccgatggtaccgtttcttggcacattcatcatggacatgacctatttgttggcggcggtcaagaatagcagtcaaaacggatcagctccaccagtctctcagataccggcgacatcaagtcttcgagataagacgttatctgtcaacactacgttccgacctgaggatgatttgcgcgtacaggacctgttgctgactctgacggcctaccagaccatcccaagatactcaccgcaaccgccacggtcgtttatcaaagcgtcgattaagagccagaaccatttccgggcgccatcgctgagctctgcgttgcagatgacgacaaaataccgcaccgcagcagtcgatcgcgaccggtccctgtcgtcgtttgaagatgacgaggacgagttgtttgggggaatccctggcagtggcggcatccggtcgtcgcagcagctgattctgcactatctattgacgaggacgtgggttcccgagaggatggtggatgagctgagtacgatccgcgagccgcccaagaacagcaacggcaaccacagtaagaccagtaacgtgtcgtcgggatccatgtccagctggtcaagcatcagtgcgacgaactcgggctacagccagacgtcgagcctggcctgcgtggactcgaggacaagcattggtagcaatgacggctccaggcctaccagtatggaggacgagtaggcgacgcgcccaaccaataaaattaaaaaatatatctccatcatcagtgacttgtgttgagtggaacgaaaacatggagacgcagttcttttttttttatttttcttttaggctgtgcgcagattacttcaaccgtccacctctctttccattcacctcaaactacacgccgcaggctcggatcctcattcttctgctctttcgaatcacccaggcgggacgctactgattcaagaaccatgaagaacctcacgctgctatcccagattcaccttgctcgtttcgggagacccgtcggcaaggacatccaccacagcgtcgatcccgagaccggccacgtctacgttgcctactcgaccgggcctgcagagggcgtgcttatcaaaatcacagatctccaggtaaacacaaaaggagttcctcacaccggagctgacctttgtcccccccctctattcgcagttcataggtactcacgattggtatgactgggctcttgtcttcaactcttcactagtcgccctttcccgaaatcacagaactggtctccttccctccagagaacgacgtcaatgcagaacagtggggccatgttgtcggcgtcaagttcttggtcgacatccaagccgtttgtgtgatcttttctcacggagacgtggttctcttccataatgaagcaaccgagtctggagacacggtaagcgaagcaccttactttgttgcagtatcttacaggttactttgagcgcactctcgctctctcttccctgcggaaacgtttctaaacacatgtctttatcaccttgtgggggaacgtttgcgttatagctagagatcgttggatctgtggattcaggaatttcgtgcatggcctggagtccggatgaggaactggtcgttatggtgacaggtactggattgtcagcaaaaggcgaagagtgaagcgcgatcagtctttttccttttcaaagaccactcacctgtggaacgatcgcaactcgatatataacgtaataggcgagggctcgatcctggagatgaccaaggatttcgatgttattgcagagaaccctattgacgttgaagagtctggagaaggtaacaggatgtcgagtgcgcctcggtcgagagatcttgctctgtgcagggattggctgtccatatggaggtacctaactcgagatctcattcgggacaaatgcacatagatgtcagtgtcaatgtcggatggggaaagaaagagacacagtttcatggaacagagggaaagcaagcggcacagcgcaaggtcgatacgtccgcatttacattctcatctgacgatgatgataaccacagactgtcatggcgaggcgacggaacgtacttctgctgttcctccaaggataagcgcctgggtaagttggagctgaacttgctatgaataccagtttcaggacgcggtgtcatcaacaagcagtggacggactaataagctcccacaccttcgttatgggaaccaaattgcaggtcgtcgcgtgattcgcgtctacaatcgtgaagcgattctgcagacgacaagtgagtctgtagatatgctggaacatggactgtcatggagaccctcaggaaatctgattgcctccagtcagcggctaccccaccgacacgacattgtttttttcgagaggaacggtctgcgccatggagagttcacgctgcgggaggctaacgacgctgtcgtcaaggagctggcatggaactgcgactcgactgtgcttgcggtatggctggaacgggcgaatggctcatgcatccagctctggaccatgaacaactacaaatggtatatgaagcaggagttgctgttcaatggcgagggatcagctgtcgccagtcttcagtgggatgtcgaatccgcgctgctgcttcatgtcgtcacgcaatcgggatcttaccagaggaatcagtactgctgggacaactatatcaacgagtctcttagccccaacaacctgggtactgtcgccgtcgtcgatggcgccaatctaatggtgacccccttccgagtcatgaatgtacctccacccatgtgtgcgttcacgctgccagtaccttacgcgatccagcacgtttcattttcagcacaaagcgacggagacgacatggcagtactactggcagatcagcgggttgctttctttgaagcggcagacaaggcggcgcggccattgccagagcccaagctcttgggtttgatcgagctggcagaagtcccgtcagtgcttgtgcgacaaatcgcctgggttcgtgcagatactttgatcggcctacagtacgacagtgatgtctctgcagattcgattgtgatcgtcaagctgtcatttgacgaagataccaaggtccccaggatcgcttccaggagtgacgttcctctggaggggatcttccagcggctgtatttcaatgcgacatatggcgatatccttctgcaacaggccgatggcaacattttgacggtggaactcaaggaggacgaggagcccaggattggcaagtggatggagcttcaccgtttgcccgaaggctgtctgtggatgggcaccaccaggatcggaacaggcaatgtggaatacagagagaaggcggtcgtcggattggcgcgcaacaatcgactttacgtgaatgatcgcctcatctcatccgagacaacctcattctgtctacacaaccacttcctggtcttcaccaccgccactcactctgcccgcttcttgcccctggagacgtcgttgtcagagttcaaaatcgtggataactcgatgctcccttacgacgagtctattcgaagagtcgagagaggatccaagatcgtcctggctctaccgtactcagtcaaccttgtgctgcagatgccccgaggcaatctcgagacggtggcgcctcgagccatggttctctctgttacgcgcgatgcccttgacaagtgtgatttcaggaccgcctttgttacatgccggaagcatcgcatcgacctcaacattctgtatgatcacaaccccaacgtctttatggacaacgtgtccgagtttgtgaagcaagtcaaggaagtcgatcacctgaacctgttcttgtccttcttgaggaatgaggatgttacccaaacgctctatcctctctcgggatcgggatcgacatccaagctgcagcaacagcaacagccgcaagcgtttggacgttctaagaatggctacggagctccagtttcacccgaactggcagagaaggtcaaccaaatctgtgatgctgtgcgcaaggagctcgacaccctcgacaggaatacgtatatcaactctgttctcacgacctacgttcgcaagtccccaccagatctcgagtcggcactactcctcttggctcagctcaaggatcaggatcaagctttggcggaagatgcgctcaaattcaccatctttttggcagatgtggaccggctttttgatgtggcgctgggaatgtatgactttgcgttggtgttgatggtggcccagtggtcccagaaagatccacgcgagtatctcccgttcttgaacgaactccggacactggagaagtactaccaacgattcaggattgatgaccatttgaagaagcatcagagtgcgctccagaacctgagtcaagcgggcgatcggtatttcacggactgtgtcaattacatccggcaacacaatctctacagatttgcgctcaaggtgtttggatcgaaccctaccaaacacaagacgatcttgcaaatctacggagacagtttgtctgttaacggcgaccacgagcaggcaggagtggcgtattcgatggcaggagacaaggacaaggcgctcgagtcctaccgggaggctgggttctggagagaggcagtggtactggctcagcagctcaagtacgaccccgcggcgctggcgtatctggcgcgcggacttgcagaacgtatgaaggccgacaagcgttttagcgaggcaggtttgctcttggcagagtatgccaaggactcggaggaggctgtctctgctctgctggagggacgactctggagcgaggctacgcggacggcgtacatgcacagtcgcatggatctgatcacgactcttgtcacccccggtattgccgacggacaccaagaattgatggagtcgatccgggatatgcaggaacagtttgataagcaaatcgtgcggttgaaggaggtccggaatctgaggatcgagaaggcacttgcggaggctgcagcagaggagatgggtgcgccggatgatgctcttgataacattgacatgatgtcggatacgacctcgatggcctctgggttcagtcggtacactgcagccaactctgtgctctcaaagtcgtcgcattcctcgcgatcgtcctcacagtaagtagccgggagttgctttggactgtcacattatggcccagtgatgatgggctgacccacgttaatcttttctttgaactgcaaaatctaggtacactgccagacttaagaagaggaacgaaaagaagcgggccagaggcaagaagggcagcgcattcgaggaagagtatctgatcaactcactccgcaagctcattgtgcgtgttgacacaacaaaaggtacatttttcttgcactccatgggctagttttgtaattttttcaattgttattttcattttctttctcaacagctgaattcaaggctaatatccctttcgttttctctctctctctctctctctctctctctctctctctctctcccctctctctttttatcaatgacacccttattattagccgatgtgcatgcactcttgaaagtcctagcagcatccatgtcactggagcgagccaaggtgcttcaacaagagtttggcaagctgctcagggagattgacgagcaagtgcacgttatttttgttccggcgacggacgaatacctggccaagaagaaggcggcggaggatgccaaggcggagcgcaagagactgatcaagcagaaccaggccaatgcgcatttgatgtcgcgccacgaggaggcggtcgcacaggcacagatttctcagctggaggagattgcagagcaggagattgccgagatctatggcgagccacctgtgatgagcaaggacagctgggatgtagaccttgtttgaactcacactcacacctttagataaagaaaagatattaaaaaaataggatcattgtctgatgtgattatttttcaagtacaagacgacctggacgtgcgcacaaaagatgagagagagagtatacggaggagagaaggagagaaggacggtgataaaagagggggtcagaataccacaatggcgcgcgatgattataacaaggttcgcctcgcacgctgatatcatacgcacatcgcaagtgaatgcgacgacggttgatcatatagcagcgaattgggtctcatcatatattctgaaatacagaaggattcatgaggatttcacagcacaaaacagagtcacggctttaagggatcaacaccagtcgtctcgcggcgcttcgtccccttctgaccacataggtttccgtgggcgttgcttttgaaaacgacgaaaaaaaaagaaattttagcgctcactttttgctgtgttggcgtgaaacagtccaagggtagacccctctctatctattgcggtctatggtctacagtcgcatgtccattctgctacacagaccttactgctgctgctgctactgctgttgctattgtggatgggaatcgttgtcatttatcgtcagagacctctccgtccgagtcctcgccagtgtcctccaaatccgtgtcccatccatcctcccactctgctcctgtcaccatcacacctccgtccgagtcctcgccagtgtcctccaaatccgtgtcccatccatcttcccactctgctcctgtcaccatcacgcctcggctcttccagtaggccttgccgtacgtgcacaggatctcctctcccttcctgatcctcttcaggaccttgcaccccatccgaatctgccccgtctctgcatccctgtaaagatcccagcccacatttggaccttcctcttgcgtcctgatctgccggaaatcgttcacaaaccggccatggttcccatgggcagaggcgtccaggttcagatcgttgctcaagtacagcgtatggtccgaatccgggtccgcatattcgtctggcaccaccagagatatgtagtcgagaaggtgtaatcctgggaagagagtcctggtcgcaaagagaccgtacgagcctaggacggggtgatggggtggcgaggtaatcaaccggatctcgtaaggtggcgacgatgagcaggtctcttgctcctgtgaccaagtcccctcccgagaaggcggcaatggtactgttgttcgaagcactcctgggagagcgtgtcccagtggtatatcgtcatactcacgctccaattcactcctgtacgttgcctcctcatgctcggtttctgcgctcacgtctcctgcaaggtctgatcctgtggcgtgggcaggggtcatcctagggacagttggttggcgacgtcgaccctggacgagatccagaattgaagaagggatggaggggtggtattcatagtcgaccaggtatttgacgtgtgtgggccagttaacgggcaagagatcgggatggatggtcgagacgtggtcgttggaactgtggtactctgtagagacgactatcgcctctgactcgatgcgcacctgcggtcgcttggactggaggttcatattgaaggcgtcgttggagaggcttgcgatgacatcctgtgattcctgtgtatccgagctgctgacatcggtgctctttctcagggtgtcggtctttgtggcgagacggttgtgcgtagtcggcttcggccgctctccttgttccatggcctaatggtatctgttttggctggcggatgtggaagagggggcggtgaaagtggtgaggagggtcaagaagaagaacgaaagaaaatagtttctgagatatgtaaaaaaaaaaaaaaaaagggacgtcgtgtggcttagggttttaagctccctcagcggaagaacttctgaggaggcgtctctctatcgttgcatcattctccaacaaacacccattcacacacatagcaatgtcagatagagtaagaacagcgttggagctcaagggttcatgcaaacacgagtacgcaacgccgcggaaacaccgcaccggaaaacaggacaccaactgctacattcgtgcgaccactatagcgatgcaccgtggcgaacaccgtgatcaggaatgaatgcttgctgcaggcgtgaagtgcttaaccctctggtctgaagcaaaaagaaaaaatcactctgcccttcggacgctcttattatcccttcgtagactctaacaagcggatgactctgacaggattgcatggaggctacagggacacgattttcctcatttccgaccgacatctcactcgccaacccttctctgtcaaactgctttagccaagaggatacaacggccgtggcggtggacgcggcggtggcgggcgcggcggtggacgaggaggtggacgcggtgggcactcttcccacacagaacggcccaagaaggagtctattttggacctgggcaagtacatgaaccagaagatccgcgtcaaatacagtggtggacgtgaaggtaaagcttccttgtctgtggtggacacattcttggccttgatatcactcttgcgcgcaaaacaaacaacactgacatgatcttttcttcttcttcttgcacaatggaatctgcagtcataggaacgttgaagggatatgatccattgttgaatttggtcttggacgagactgaagaatgcctcagaggtaaaagagcaaggatcgacgtgctgtatttcgttcgaatgatatgataatcaaggttttctgtcgctcaaacagtgcactgtttttttttcttttttgtattacactccttttcgcgtggttatagatcctgaggatggtcgtttgctggaccagaccaggacattgggcttgatcgtttgccgaggcccatctgttatccttatctcgcccatggatggtacccttgagattgccaaccctttcattcaggaggaggaggctgtcatttgagcagtgatgagtatggccccaataaacaaacaaaaccaaagttcagaagaggccgtacaattactgcacacacgctcaatcacgtcgatgtgtctatggatacgttttaattcatcgctcacgaaacggttcattttttttaaccccgtccgtctttcgaaatactctgttcatttttcttttctcatcaattcgcttgcatcgagaaaggatttgtcgatgaaacagccctccttcacagatgctccttctccaaggtccaggcgctgctcgtagagaatccggcgggcgcagttggttgatgctgttgacaagggtcggtgcggatatacatgttcagaaaaaaaattagaaaatggtcttccggtcgtgctgtaaggtcctatggcgatttagtatacagatactcaccgattggccacgctttgttcccgtgaggcggaagtcgcggtccatcatgattctgtcccaacgatcgattccgtatcttggaggctgcacaaatgtagataaacacgacgagagaaatggtcaaacattcagtcttgatccccatgtcgtttggtttgcaagtgtggtgatccaagcaagatatttcgtcctgaatttttctgagactcgattaagactgaagcggacgatccagtgcatctccatgaaatattcaagacgcattagggtgctgcatacagacaacgcctgcaacttctcacgctggtgcagaaatcgtaatatcgattgggaaagcaatgcagtgtatccgatcgatcagaggtgccgtcgtttgcgtcgattttctctgaaatgatgatgatccatgatatccgcggtacaggtccagggaaagacaaaaagggagcggaaaccgaggtagcaggaggagtgtccatgacaactaagtgaatggctctccaaggcaaatgcaggcgacactgtacctgtccttcgttcacgctgttcttgagcttctggaacaagagaccagagactccgaagaatcctgtgatcaagctaggagtccagcaagatgaggcattgagtgacaaaaaaaagggatggggtgagtatcttcaataataaactcggattgattcgccgaaggtcctccgctcgatctcggcattgattcagtccacgatgctggagctggagtcgcaggtgtgcatgcgctagagtagaaggacggcggggctagcaatcacaaggagcagaccgcgtacccaaggggaatcaaagcctcgaatggaactggcatggtgtactgaagagtggagtgggtgggtgtgatgaacgcagttcgtgatcatcaaagtccggcatttggtgccggggggagaagtcacgtcaccgaagtgaaagtcctgcgaatactgccttcaatcactttcttctccgcgcaaacgaggcacgtcggctgccagttctttagaccggatccaggggcatccatggtatccttcccaatcaggtgaattgactatttatgtcttggagagttcatatctttctttcttttttgcgatctatgaacgcatcatggagagggtcagggatgcaaggatgcgtgtgaaaaaagtagcgctaaccaccagaaaaaagtaccatagaggcgatactaatgatgcaaacaggaggtaagcggagctgaaggggtgaaaagtgcagatgttctttgattcagagagaggttttcccaggggacattggggcgtgctaccggaccatgcctgtctcacgttgttcctgacacgtatcgaaggacgtcctcaactggcttaaaataagaaaggtcgactccacctccttgcaacgcgcacagcaggcgcggttttgcgactcaacagcatcgttttcccctggcaaccacgcaacaagtataacgtaaacagaaaagtaccaagaatgagaatgagaacatggcactagtaagttagaaggtgatgcaaggctgagagcattgccgaacactatagttgcgtcggttgcaactgcgacatgcagggacgagaaacgtctcaaagaacgcgtgggtgtcacagtagcagaattgaccatgaacgctcagtagccccgcattgaatgggtagcgagctagaaagtacaacaataggctaaaaatcagttgcatcccgatggcctgctctcgacgatcatgcacaatgactggattctttgcactcaaagaacaataagatgtcatttttctcttctttttacggcgctaatagagactagcgcatcaagttggggagctgccttgtttcctgccttacgggcgtaatcctcctccacaatggaactaaaagtgcatcatctgagagggcccttgtaattcaccgatggctcttacggccccctcgctttgtactattcttatcgatagaagaacatggtggataggggtgtttcacagcgtgaacgaattttctcttctttattttttttttttttcctggaagacgaggcataaacatggccaacggtaatgttattagactatatatatttttttttttttttttttttttttgctggggaagactgggagatggccaaacctgtataaacgatctcatgaatcatatcggcgctcggagctgtccaccagtgcttattcttcctttaagcgatcacacccgagggcatcgttattgtagcgcccgtgtttccctggacaaggctacggggtatgtctcaccttttcctatgcaggaagacgcagagtttgcataaatggaccaggctccattcctcttttggatgaggcccatgacataatatgagcctcggcgagcggcctggcgtggtgtggtgtgtgtgcctgctttggcacacaattcacgcaataccgcaatacgcatagtgcatggtgcatagtggacaagtgtgtggccttgtttatattcagcacgcaacggtaatgtgcgtcagcagcctctctcgaaacgtacatgaaccttgcaccttgggcttcgaagtcatccctcaaacatgcccttattggctgcttattgcattgcatggtctgtggtgaaaaaaaaagaaagagaaacgatagagtaagactctttttttgcaatgcttcgaatttccataaatgaccgacaatgtggtggctccttattcatgaaaagaaaggggagagcaatctcgttcggaagtgacgacactgccatgcagatatgaagggaaatccatacatctagctttgttgacgatggccatcagactgtgattccaatgatgctgtttacgtgcgccaagcacgggtgggcgaccgttggtgccgcagacagggctcctgatcgcactcgggctcgaggcctcggctatgatccctggctgtgatgcgtctggtggccaggcccgtcactgggaacgaatgagaagcgagtacacagttcgataattcccttattgaacacagacgtgctgatcaggctagcgtatgacacacgcaaggccatacctgctagtccgcgtggctctggccggcaaagttgtttttatgctcggcgctgaattctcgacagcgaacaagggccaagccagacacatgcaagatgttccagtccagttagtctaacagtcatcgagccaggcgtctagaaagcgctactctatcaccggcgatagccccgacaagaaagaataaagggaacaggtgcgagcacgggagggaatgagagtgcggattcaaagagcgaaagggtactcaacacacttcaacacaactcaacacaagcgacaagagaacagacccgccaaggcatgaagcaaatcgtgcctctccccgatcttttgatgtacttatctaattcaatccgtgcatgatttgttttacaatttttttttctttccttactgttctcgaatgaacgggggtaccagaccctggtcgtataaaaagcccaggcctcgcatgctgcccttttcttctttgctttctttgctcctcataccgacctccgcatccacctcttttgcgtccgtctctttgtttttctttctcgtctgccacgctcaaccaagaccagctctctcttctctctctctcactctttgtgccttgtctctccacgcctttggtccactcatctcgactcgactcttgctcgcttttcgtttgacacacagactcagctcgactctccacacaagcgtctcttggtcaccaaaaaaaagcacatcccgtccaaccctcgtttctttcgctttctgttacgcctcttcaccatctgttcattcccggcgtttcatccagaaaagtctattattcttgtacacagagccatgtccttggaagccagcgatattcgtcgaggtaggcatacttgtcgctttctgttgaagcggacaccacactcaaacgcacattttctttgttcttgttcactcttgcatggactctgcagcagcaccatgtcctccgcgtctcccttctcgcactcctattctcgcgcactcctctgcgcgcattttttttgcgcgcgtcctacattcatacacacacactctctctctttctctctcgctctctcacactttctatcctgcattctttcctcgaaaaagtgcctcaacgcctcaaaaccttatatccgttgctcatctcgcatggcgtcgagcttttcggtctttgtatatatatactcacatccaccaacatcccttgtattatgctttttgtccatcttgttttggcattttctccccggtgtgcttctctgtttcctctctctctacctcccatcattcccatcgctcgtcgtgtaaactgtctgatggattcgtgcaccaacctgattctcccttgtgaaaaaaaagacacgaaccctactcccaccaggttcttgctggaatgcggagagttcacacccgggttcggtcttggcttagatacgccctacaacgcctatgataccagctacaaatttctcggcaacggcacctcaaaagtagactcaggcctgtttgatactgccttcaagacatcccccagcagcacatccacgtcgcatccgtggtcggatatggtgtttgatgacgcctatatgtccttgcgccagatgtcgcccgggatctctcctcttccctctaattcctctgcgtcctcgctttcatcgcctccaccatattcaagctcctcgagccttgagagcactcgcgctattactcatgaactcaaccctgtctttcataaatcttctgccccaaagccgtatcacagtgatttggaaccaccatctctcgcacctgattcccccacgccagattctattgttcccagcgacgccatccgtagagacagcgtcatgactactatcagccaagacgacatctattccgtttacggactcaagaatggcctcaatcagccccaagaccaagacatgagcgaccaccacgactctggtatggacgtggactcggacgaatcgaacgatgaggatggctctcctggatcctcatactcccgtgaatcctccattacgagtggagccctcggtacagttcgtactcttcggacgcgagcatctgcccgcgctacacccaagtccacgtcgaccaaatccacgtcccaggcatcgagatcaagaaagaccaataataccaagaagtccaccccagctcctcgcaagctgaagggttccgccaagttgccatctacccctacctccaccacatccaagcggccctccagctcacgaaagcatagctcacccgtcgaagacgaggaagaggagtcgaacgagaccaagcgacgaaaattcctcgagcgcaaccgtgtggcagcctccaagtgtcgcgaaaagaaacgccagcaaactctaaagaccatcgcagatgcggacgcgatcacagcgcgtaatcaagcccttcatgagaccttggacgagttgcaggaggaggtgaggactctcaagaaccagatcctgtgtcaccgaagctgttcttgcgatgtgatccaaaagtttgtgcagagcagctttggcaccggctccttcatgcccgcttcccaagcaccgcgctccatgtcgatttcatcggattctctcgcacatcactgctaaggcgacacttctgcctaggagcttattactccttcaccgtcttctgctttcctcatctttcccttcatgcacgttatataattcgccctctcttcttgcatgcatcctacatggcccaatctcttcgttaagaagactttttcctcccccttagcaactgagttctctacgcctctctgtactgtaccatatcccttcattggttgctttgtcatttatagtctttctctttttcatgctcgttgtctttgtacataaaaacgaagaacttgtgccctctgaaaaaaaaaatgccgatgtgtgcagaaaatctagttatcaagtcgccagctcttaccaacggtgtttgccggggtgcggcaaggtctgttgcacaggtacagctctcaagacgaaggtcccgtcctttttttctcttctcaatgctgttcccgttgtcccgagctgcacataaggttcacgagggtgggcgcttaggccactttttcggcgttggatcaaccattcgctgaccctacttttttgcccttgttcgcccactcccgcgggtaaatgaaagaaacattggagtggttgaggaacgaaaaaaaagaaaccaagaagcagcgagcacacgttgggatcgttttatctttcatgcatgcacctgagtaccgttgatgaatgtgtgtgttgcatgaacaaaaacacaagaccgggcctgtgcatccgttttttttcttttgttttcattcaaagcaaaagacataaagctcgttctcgcacctttttttttcttctcccttttcactcaccctctccctctctcttcattcctttgttctcaactgttcacgacaactctttaccacctcgcctcgcgtctctcgtttgctttcacaacccgaaaaaaaagagtcgccctctttcacattgaggctagaggttgaattgacattacccattccataaagagttccacattcaccacgtcgtcatgacagcaatccaatctgaagcaacaccggtaagtttctgtggcgataagggaaagcagtagagagaaagaggtagggagagagagaaagaaggagaaagcgacccatggtcgtagagaaccacgacccacctatcactctggtttctctcgtgcctttgggttggcggcatagcacaactgctcaccccctcttttttttcaatgataggccattatgctggaggccaagacatttagggccgtagagttccctgaggatgtcattgatagtgtggtttttgaacagctacttgcactcgacgaagacaccgcgttcgtgagaacgcttgtggatgactactttgaacaagccgaacggacaatcgaggagatgcaggaggctgtgtaagtttgtggagtgtgtaaataaatgctcgtttcatttcattcgtttttggctattctttgttccgtccccttctccccttctctctctcgttcattctctttttctctcatgagccttattccaaatggccgtcttgagtgggagaggaagggacgatcgcgttttggcaccaattttggccaagggcaagggctaactgtcgcgcttccttttctctttttgcctccctttttttatttgtcatatggcactgcaacgtccatcatgcacccctccatcagaaaagagaaaaaattcaccaagttatcagagctgggccacttcctaaaaggatcctcagccgcggtgggcatcatcaagatgaaagtatcgtgtggcaggctacacaattacgggaaccggctggatgctgagggcatcaacacgctgaaggacgaggaggctctgaaaatgatcgagaagctgctaatacagatgcggtcagagaatgaagaggccagggacagtctgacgcaagtcttggatgaacgagagacaggaggtagaagtgagtttttttaaaccattttatttacaacaacaaacaccgccaagggagagttgtacacgcattattgtacgagtagaaacgtaggtttataccgctgtatatagtccaatcaagaaagaaacccgtgttgctccatcagcattgaatgtggcctggaaatgaggggggaggggagggagctgagaactatagatggacgtaatcgcatatgcgcagaaaatcttacagcaaggacctctcgcgcgccatttcctgcgctagggacgcgttgcctacgcaactgccatgatttgagtctgaaaaagcggcgacggagatcgtagtaagagataaaagaccattaggaaatgaatacatcttttcaatcccgatcttgcaccctgcgcaagcgccgtggggtgagttgatgttcgacagcgactgactgccaatgagatggatgcgattttgttgacaaggtagcttgattgtcacaccgacaccgtggtctctgcgttcaagaacacggcgtgcctgcaagtgatcaacggcccctctctccttctccccctctctccctctggcactgccaccgatagttcggcaagaggagagggtcaagttccatgcagaaggaaagaagtgcgccgtgttcactttcgagaacgaacggatcggctctctgatgaagaacgcgagctttttagcggatctgtgatcaagaagcgtgacaaacgcagcggaatacgttgagcagtgtagcaatcatgcatcggattcattccttccatcttcagacgaatggaacagatataaaaagcggacagactttttagcctcatctctcctcatctctcctcatcaaaactgaaacttcccgcctgttcaaccctcaaatcaaaaacagaaatgaagttcaacgtcgctatcgcccttgctgccctttctgccattctttcggcttcagccatgcccgctgatccagcgaatcccgttaccggttgtaagtcgcgcacagggaggagggggtttttttatgcactagaactttactcatgccttgctaatcaatgacgttcacaatctttcttgctgcattagccttgacagcgcgcgccgaaaagtgctgcaagtattcaaccggtcaatggtgtggacctcaaggctgctgcctttggcaaaagtgcacacagtacggtggccctgctcagtgcggttactctggctgctgcatgaagtacaactgctgaaaaccaagtctttcttcgcctttgggcgcttacccaccctcctttcaagatatgcccacgatcatgaccacacgttcgaatgtgtttgatcttcactcccaataaaacaaaaaaaaacaacccaactcttttcgattgcaacatcatcagaattcagtgtataatttattcacaatggtctatgctgtccatttttcgtttgtagtcattattcggatcggggagtagtatgttctataaaaatcctcgactcgtctatatgatgtagatgccatgctcaagtcgtccaatccattgcggtagcagacctttacatgttaacggcggggttgaagaacaaagagtcatcaccccaggggaaggcctaaccgaaaagtgccaagatgaaagctgcagtcagtataaagtagacaacaaaggaaccaacagtctcaagccgtactaagccaagatgaaacctaccctcaagcggagacgcatgtaagggtacttgacggcctcatggccctcgtggcgctcgtgctccaaatgagcctggtgcttggcccaaaggttgtaagcgttggcagaggcggcgatgacagcgggaatgcaaacgtagatggagatcttgcgccaggtctcggcagcggctaaaggtcaagtgtggaaataagagagcagagtgagtgtgcggctcgctcggatatgactaatagcaacgtctctgaaatcctcgccgcgcgtgggtggtggaacgaaaagggcgaaccgttctaacggctagaaaaggggagcagaagcaggacgagggtagagaggaaactagagagagctgcacgtgcagcgaaaagagaaacgcgtttgtgcttagctctctctctacaccctccgccactgaaactcggaagggtcaaaaatagacctccgagttggatgggcactattcgtccatgtccacgatcggatccgagcccctccagatcctgccgcttctgacgagtgtcccgttgtaatgagtcgcaatccagtgattcccaaagagagtgtccatggatccggggaaatgccgctaacttgcatgagtccaagagtgtaatctcgggcgaggcgccatccggtcaggacgccgagggcacggctggaaggggggaggagagagagagactacgtacgaccagcgtgctccttgacggcagcgcgctcggccaaccaagcgttggaggcggcggaggcagaggaagagaagcggatgcccttggcagcttgagcgattctggaggccattgcgatagtgatgagtgttacaagaggagagatgcaccgttccgtgtttggggccaaaattgagggcagggggcggggcccgattgagtgcaacgtcaaggaatgtccggtggctgcatctgctgagtcctccagctgctggccagttgtgcaaacaaactatacagcagtcacgactgcaaaaaaaaaaaagaaaaaaaaactaacaaagaaaacaacatccacctgccccgttcttgttcatcacccccttcctttctcaccacatcccccccatccacccacttcgtcttttcagcaatgggacaacttaagaaggagcacaacagagtcgccgctgccggtggctccaacggcctcggaaacgtcaaggtcaaaggagagaacttctacagagacgccaaggccgcaaagcaggtccagctcctgaagggcggccgtgctattcgcaacgcccagggcaaggtcatcaaggccgcctctttccagagcaaggttgtcgagcctggccgtgtggcccccaaccgcaagtggttcggaaacacccgagttattggccagaaggccctcgagagcttcagagagaacctcgctgccaaggtcaacgaccccttccaggtcctcttgaagcagcacaagctgcccatgtctcttctccaggatcccgtccacgtaagccactctccttcattgtgcgcctacagcctctgaactcggttagctcttaggctccttcttaggatacccgattactaatcgctttttgtaattgactgacaacaggttggaaagatgcatgtgctggagaccgagccctttggcaacacctttggcaacaaggcacagcgcaagcgcccaaagctgtcaacgatgagcatggaggatttggccgccaaggtcgagtcgacgctggagacatatgatgagaaggcagataagaacctgacgtcgaacgttatcacggactggatcgaggaggctagggacagcgtcttccagaagggacagtcgaagcgtatttggggagagctgtacaaggttatcgactcttcggatgttgtcatccacgttctggatgctcgtgaccccatgggaacccgctgctccaacgtcgagtaccacatcaagaaggaggctcgccacaagcagttgatctttgtcctcaacaagtgcgatcttgtccccacctgggtcactgtaagttcaagcgtcgtgtgtacttcttgtcgtcatggttgtctagtgccaaactgtgagttctgaccatgctacgttcctctcttccaacgcttctaggccaaatgggtcaagactttgtcaaaggaataccccactctcgctttccatgcctcgatcaacaactcgttcggtaaaggatctctgattcagctcctccgtcagttctcgaccctccactctgacaagaagcagatctctgtcggattcatcggttatcccaacactggaaagtccagcatcatcaacacccttcgcggcaagaaggtctgcaacgtcgcccccattcctggtgagaccaaggtctggcagtacattacgcttatgaagcgtatctacttgatcgattgccccggtgttgtccacccctcgaccacggatacggagaccgacattgttctcaagggtgtcgttcgtgttgagaacatcaagcagcccgatgattacatccctgagcttctgaagcgggtccgccccgagtacatccagcgcacctatgagctggatcactgggaggactctgtcgactttttgacccagttggccaagcgcaccggaaagctgatcaagggaggcgaggctgatctcggaagtgtggctaagatggttttgaacgactggcttcgtggcaagatcccatactacaccgcacccccagagggtgacaagcccagcaacggcgagaccgtcttcgaggaggaggaggaagtcgcaagaatagatccctcgttgcctcatgtcgagcagatcttctccaagatccccgttgtccaaaagttcttggccgaggatcttgccaacaatgcatcccttgttgaggaggagaggagcaagcaggagagcaatgcccctgagggtgttttgcctgacgagattgacgaggacgacatcaacaagaccgacgacgaggacgagggtgacaagagctccaaagcggctgtcaagccccgcaagagcaaagcacagcttcgccaggagaagaaggccaagaaggagggcaaatccagcgtggtctctggtgagaagttggactgggatgatgtttttgctaacgtcgttggtgagactgtggactctattccaggacaggagaaggagagcgaggatgatgtcgacagtgagttggagctgtcggacgatggtgccgagcgcaagcagaggatcaagaagaaggctgctgtgaagcgcgccgctgctgccgatgtctcgtctggatttgttgtcaaggaggccaaggttgagaagcggacctcgaagagaaagcacgttgaggaggaggagcaagaggaaaaggaagagtccaccaaggttgtcaaggaggctcgtatgacgactaacaagggcaaggtcggtactcactactatgagacggccaacgtcaagaacaagaaccgcaacaaggtcaagcccgaggatccccacaagctcgcaacaaggcttcgtgaccagggcaagaagcgccgccagtagatactctatccttgcaaccgagtctgctcttaccatttttgcgcctgctcaacgactagcatggtcccactcgcccgctctcttcccctctcctctcatcttttccgtcatcactgcacgccttcataacgatacacttgaactctcttgtacaataaaatcatttagcaatactatacattttatttctcggcctttactcccagcacgctctactcatcatcctccgctttcgcatttgggtccgctccagtgttgacggcagctatgctgtcgatctccagttcgaaaggtcccgatttcctgtcaatgatggacacgcccacgttcttgactctctccctaaagatctcgatttgttcctcttggataaagccctggttggtgaggataaagtccttgaacgggatctacgggaacaatttatcatccataaaacaaaggatgagcatcagggtgtctctgacatgatatttggcacatatgggccgttttctgtgcagatccttaccaacactgtttcccattcacccggggttttcaagaaaagacggtgttggtagagatctgttgggacaacaccgtctgtttgcaggttgacaaagtatttccgttcatcgcccttgactctcagtgacagatattcatacaggcaagtgtcccaaacaggtgttccaaagatagatccaggcttcgtctacgacatgttttgcaaaaaaaaaaataaaaaaatgaagggtcagtagctagcgaggatgttgatactcagatatcaaacgtgcgtcgagaaggggaaaagccttatcacctttgtcctgcatcctgcatatccactcttctcgacgttctcgttatcaggaagatccagcgacaggtgtccataaaagcgtcctatagagtaggtcgagatcagtcttcttttttcttgctcggccctgcggccttgcttttgcttccatgggagatactatggatgaggtgcgccatggctatctctcgttacctgtgccgttcttagtgatctccagatgggcttctgagaaccctccaatgtccttgtcacaccccacgatccatcctttgaggtcctcctgtgtctttaaggaagccatggggagttgcctcttccagggcgagtgatccattttgacgactagcgaggaatgcaaacatgttcacgcgttaaggctctggcgaggagcgtcggctgctccttgtagcgttcgttaccgatttcgaggaatgttcaacactggtacagcggtatagagcgcaagtgattacccttggcggtctcggacccaatggcgctgagcgagcgtcgaacgaatccaagcatgactgaaagctgtgtccgtgctatcggttttgttgatggtgaatgtcaatgggttggtggagaaatccagtgtgccccactggcccgagatcagttttcgctgaaggtggctttgtggtcgcaccggagattcgtggcagtccccttcatggcttcaccgatcacggatcggcacttcccgacacacagcaacggtcgccgtagaacgctcggaccaactgtttgtcgtggccccccttccctcgcctgaattcagtcactggcctgagcaactgcctatggtcactgtccatggtcgcagccttgtgctgtgcgatagctgtcaggagagaggggagccgcgaactaggatcatcacggtttttaatctcactgaccattctttggtcacagacgaccaacaggcgtgggatccacgccagcaaagtagcccttcacgcgcttatcgatggctgacattgagagcgtgtcgcagcgaggcaacaactcgtgtccatcctgctgcaaaaaggtgaacgcgggattgacaaatagggtcgatgtccgttcaaccataaaagaaaattagtccctccccacaaagaggcccgggagccttggtggaaaaacacgacccggactcttcggctgcgtttgtgcgtcttttctcatctgcactctcactttcactcattcagatttgacctcaactcttgacatgacctccatctcgaccaacaagcgcctcgagcagatcaaggaccacatcattggtgagagagcacccctccaagactgagttgcatccgactctgacgcgcatgtgcggagccgaaacctgactgcgacctccattcctcaacgtgcttgactctaggcagcagcacccacagggagcaccttatccaccacaggcaccccgacgatgtagtgattgtctcgtaagtccgattgaacacccagagggaaccttatcgcccgctggttgaacgtaccgtgttagctgttactcaggttcgcgtatatgcctcgtctccaaatactcttctcactagagcggtccgcacacctatctgcagagccggcaagggtggattcaaggacatgtacccagaagacttgcttgcggtgattctgaaggccgccgccgaacgcgcaaagatcgaccccaaggttgtcaatgatatccaaacaggcaatgtgctccaagagctcggcggtatcaaagtcggtcgagcggccatgttcactgcgggtaagtgacaaatgcacgcgatatccggtttcaggtggggggattttttgggtgcctctgttgacctttgcctggtattccttactcaaatggcgcttctgtgtgtccctgcaaggctttccttacacgaccacctacggtgttctgaaccgtcagtgctcgtctggtctgcaggcctgcaattatattgccaacgccatccgggcgggtgagattgatgtcggcatcggtaaggaacacctgctatcgttcactatcgcttgataacactgcccacgcctcgaaccattgtttcactaacatccaggcacaaaatctgctctgatcctctactgaacaaggtgcgggtgttgaatccatgacccacgattacggttcaaaaagcatgccatcgcgaatctcagcctccatcaaggctggacccggcgctgcagagtgttttgtccccatgggcatcacgtctgagaatgtagccagcgactttggcatcacgcgtgaggcccaggaccgcttctcggtcgagtcacacgagaaggctttgagggctcaggatcaaggattgttcaatgccgagattgtacctgtcaaggtccagcaaaaggtcactgtcaaagatgaaaatggacaggacaagcaagtcattcgagaggtcatcatttccaaagacgagggtcctcgtgctggctccaccgtcgacaagttggccaagctgaagcctgtcttcaagaacgacggctccacgactgccggaaacgcgtctcaggtctcggatggtgcggctgctgtcgtcctgatgcgccgaagcaaggcacaggagctcggatgcactattcttggccgctggtgcggagctcgtgtagttggctgcccacctaggatcatgggaatcggtcctgcggtggccattcctgcggttttgaaggacgtcgggcttcatgcggacgatgtggacatctacgagatcaatgaggcgtttgcgtcccaggccttgtattgcgttcgaactttgggcatcaagcctgagagagtcaatcccaagggtggcgccattgcgctaggtcatgtatgtgccacatgtgtattccaaacgcctagagattgttaatggatgctttgactgatattttttgttgatatacgctgatatagcccctaggcatgactggagcaagacagatggccactttgatctcacacctgcaccacaccaaccaaaagattggtgttatatcgatgtgctatggcattggaggggtaagctacttttcttgaagcgcgttgtcaccgatggagcgtctacttacaggcacgtacgtttttcccttccccctgttgggtttgtagggtatggcagccgtgatcgtaagcgagcaggatcgcgattgaagagagagatagtcgatacctcggtccaaataaaaaaaaaatcactctgggctgttcagccgtgtacgccattctttttcacctccaccgcacttttccatttcgtctgtatttcacacttgccatcaccgcgcctttccgggggtcacattgtcaatggcagccggggaacaaagtcttgaccatttcgcgaccatcacctacttgacctccaaaccgaatcatgaagaagcaatgcggatccttagaagggtggccaccatggtaagccaacagtcaaaacacacagctttttctgtcttttttacgtttcgacaaaaagtaacccccacccactctgactgatatattcaccaacctctcgaccaggtccggccgatcatgaaggctcacaagtggaagacagagatcctcgccgagttctacccaaaaaatcttctcggcatgaacaccaaccgcggctggaagatccaactctgtctacgacaccacgacgacgtgagccgtttcctgccatgggaagatatcctagggaccatgctccatgaactggcccacaacatccgtggtccgcacgacgcacagttttacaaggccatgaacgatctcaacgacgagtacgacaaaatcatcgcgtctgggtacacaggcgttgggttcgatgcgacaggtcaacgactcggtggacgcggactaggagggagtgctcatggatctcgtgaggcagcgattcttgcggcagagagacgcagacgagtgaatgagatgatgttgcctgctggaggcaggaaactaggaggaggaggcgccggttcagctcaggatccgacgtcaaaggccttttgggaaaaatggcacagtcctggcgaactcgcggctctggcagctgagcaacgtgctaaagatcaagtgtggtgtggctccgccgagaacgacaacagcgagccttcgactccggtggtgccgaccgaaacgcgggtggaaactaagaaccgcgagttggagaatgaaacactggaatcagtggtgtcagaggcatcacgctcgatcaatctcaaagcagctgaggctgcaaagcgtcgactgcaggcagattcaagtcgggacgtcggagaaggcagtaaaaagattaaacgcctacccatcagcaccagcaccagcaccagcaccagcaccagcaagcatgctcgatcaaccataccgcaggcttcagggacagcttcagtacctctgaccacagtcatagccgcagaatggtcagaatggtcttgtccaacatgcaccctcttgaacaagcccttggccctccagtgcgactgttgcttgaccgaaaggcccttgtagagccgcacacctgtatcgtgtatcaattctgttcatcccccatttgtatcataaaagcggaccaatttctttcaatgatgtttagtgacaggcaaggtttattttcgagaaacgttgatgaatatggtacaaacaatgatgctctggaaacaaaatagatgaaaaaagaatgcaaaaatatatgtataaagaaatgaaggaaaaactatgcaacaaagacacggatcatggagattatgtgaaggagtgtgaatgggaatcatccgtgtctactgtgtggcagaggcaaggagagaacacaaaggagcggtcgacaggatttagaaggtgaccttggatccctggaaggaaccaaatcctccacggttagtggagccaccgcgaccaccgcgaccaccacggccgccacggtcaccgccaaagccgccacggccacgaccaccacggccaccacggtcaccaccgaagccgccgcggccaccgcgtccaccgcgtccaccaccgaatccaccaccaccctcggagcgctcgggcttcttgccggcgtagtccaaacggcagggacgaccagcgagctcggtaccgttccaggcaatagcagccttggcctcctcgatggagccgaactggacatatccgaaacccttggcctggccggtctcgcggtcagtagggaggcggacggagatgatctcaccgcactcggcaaaggcaccgcggaggtcatcctcagtggcgttgaaggacaagttgccgacaaagagagtgtcggaagcctcaccctggggggcgttgttgaaggtcttggcaccagcctccttcttggggcgggactcggagagatcgacgcggatggcacggccatcaatctccttgccagcaagagccaaagcggcgttggcaccctcggcgttggcgaactcgacgtaagcgaaactattgagtaaaggaagagcaaagaggaatgagttgcttggtctttcgaggcatgaatcagcaaggcgtagatcctaatgccatatatggctaggtgaaaaaagcttaccccttggagcgctgggagtcgcgatcggtgatgacacggacatcgaggatctcaccgcactcggtgaactcggtgcggagccagtcgttatcgacgttccaggagagacctccgacaaagacggtggcggactcggcaggggcatcctcagtcttggacttcttgacggcaacggtctcgtcggcctcagtcttgcgcttgttgttggactcggagtcagagctggcagcagactcggaggactccttcttctcctcctcggcatcagagtcagagtcagagctggacgagtcagagtcagaggactcggccttgtcgtcctccttctcctcctccttctcctcctcggaatcagaagagtcggacgaggatgaggagtcagactcggaatcagacgaggatgaggactcgaccttcttctcgaccttgggggccttcttgtcggccttgacgaccttggagctcttggcggcaacggacttggccattataatatgtgtttgggggtggaaggggcgggtgggggagggataggggagtgggagagagagaaggagcacaaaacagggaaatcgaaagccgccttgctttgaaggcaggcagaaaaaaaaaaaaaaaaaaaaaaaaaaaaaaaaaacggactagtcacaaaaacataaacaacaccctttttcgcttgctgcgcgagcgatcatgccatctacacccaccctccacaggtttgtggctctgtcgtgtcgtgcagcaccacagcctcgtcccatatgcgattggttcccaccagaaacacataaagaagaaaaaaagaagcacttaccgcggccgatcgctacagtgctgcattactctgggccttgcgcatacctgtctggagtaaagttgaagtttgggttatgaacggcatacgatatctagaggaggctataaattatatttcatggtatggagggcagaacagccaaagcactattctattgtcagccttggcttctttcctcctcgctcgtcgaggtacttcagcgtgtacttgttaaagaactttaagacacctgcacccacatcgactacagcccatccattctcatcgaactgtgctttttcatgcaaacgaggggcgctggctccctcggaccgtgcgtccaggattgtctgcactgggaacggtaccttaatcaagtgcttgatggacttggtcttcaccgacttgggcggtgtaaaccagttcccactgacccagctcttccgccccagtggctcctctgtgtcaatgtatccgtacaaggcctcaatgctacgcttgctcgcgagggcggacttgacgtgggcagtagtctgctggagtgtgttgcggaacagagtgaacgctcggatcacatctgtgaagagatgcagtgtccccacagaggagggcagcgcgaaccggtactctggccaggcaacatagagacggggcgcgaccaggtgcaccgagaacacaattcctgtgaggcagctgatctgcataccaagaccgaccgtgcggcgaggaaagtccttgttgtcgggaaagatttgggctagacggtctacgacccctttggcctctcggagaacctttgtgccatcggcaaagattttgacatcttggtagttacgagctacctccaccgcggccaaatcaatttctccctccaccgcatgatcttggattattctcacgtcaatcttaaaggcaagagcgccgctgtcctcataaaagcggcgtttttcaaagttggaggcggccgcggttgactcgccagttttgagcctgaggtccgtttctccttgacgctcataaaagagccgagacaataatggctgccagagtacgttgaggaaatctgcctccgtgatatcgacctttcctaagaagaggtgctggttgttgatcagggcgtcgaccatgatcaacaacaaccacaaatcattgaccttgtcagggacgcaggctgccatttctcgaaagaggtaagatcgtgcagcagagagacctcctgacctcgcaaaggccatgacaacgtcccagtgcgcaagcagttccaccggctcttgaaacttagacgacttaaaaaccctcaaatggcggaacatcgccagcagctcatctcgctccgtgctatcagagaatacttgatggagttggctctcaggtgaccggtccaccagatccagaatcgatgatcctcctaaggcgtacactcttcgttggtgcacgctcgcgaacccggtctccgccaaaagatccaactccagagcagcctccttgatacgttgcccaatcgtttcagtgcctctcttcaaagtgagcccgtccacccgcagttcgtcctctgtcacagacgtgctgcaggatgctggacccttgttaagggtcctgggcgacctccttgccttggccacttctgtgggtcgccggacttggcgagcaaaatagcgttccactaccattctgaatcgatccgtcttcaaatataacgagaagaaatcaggtgttgataagcctcggtcactttgactgcacatcaaggcaagtgagtcgttttgtgtaccttgacatcttcctgccattgttggagccgatccattacagcgcttgcgtctgatgtctttttaatcgccccattgatggccgtctccagcgtcggaaaaaaaacatccgcgctgtccagggcgaaggcttcagcaaaggctgcaaaggccctgtagatacacttgtgagatgtcttagtaatgaaatcaatggtagacatggtggatagagtatcgacgtctttgaggaaaggggaatgaggaatcttcctttttgctaacacgttgaggttcgcagccatagcagtctatgcgctgtggctcctgactggtgtgtcttcgtaaattgcttcaattctcaaattttcagagcattttcagtccatagggccggacccacaggacggagcggctcagatgagacaggtctgccaaatgtgactgcaatctccgattagacagtataaatcccgccgtggtgtagtaaaagatccacatctttttgatcctccacagtcgcggagtgaccgagatgcactctgactcctttttcagatgcaccacgccctgccaagctgtaggtagcagttgccaagccgatggagatgcactgtggtagactcgtctccactttccaagctcacacggatgccctctgctatactcagatgccttgtcgtggtccaagctgttgaggaccagtttccaagctctggccttccctgtggacccccatcctctatttatcaatatacaatctcaaaataaataagcgatcgtgttgcaacactgttccttctccattgctctgctcggtccatccacgacaaagacctgttgagtggacttccatcaacagagtgccttttgtatttagacggaagccagcatgtgttcaccatactcatcgcgttcgaccctgctcacttccttcaacatgctcctccactgcgtcaatctctaaacggctgatgcgacggtgccctctcgcaagctccattcatatccagagaacggcaatgagttgtgcgaacgggtcttcgggttcactaccaagcgcggacagcgcaaggttgctgaacatattggccgtggagagaactgcagccttgtcgcaggaagtggttcgggcaagaccctggcgaacctgatgccgctggctttgtggacaattcgcaacattcgttcgtttcgcgtcaggtaaaacaacttgaagcgcagcatcagaggcttcaggaactgaacaacagcagcatccccatttacaatggccgtcaagtgccctggaacatctcggacgtgctcaacgcagaaaaatatagtgccgtctttgtcacgccagagatcttcactagcttgcgctgcgaattactctggagtgagccaggctggaagtctcacgttcaagctgtggtgattgacgacgcgcaacctgtcagcacctggagtgcccaccttaagaaagactactgtaaatttggaacttcacgctcttgaatcccctcaggtctcgccatcgtggaagtatcggcagctttttgcgaaccacagcttcaggacctcaaaaggaaccttcgctttgcgcccaatgtcaaggtcagcagagccgataaggatcgttaaaataatcgatacgaagcgcgtgcatttaaaacctcgagagcagcttcgaggagctggattttcggccctttttcaccaagaaggaagacatgatggtatgatggtggtctacaatcgtctaaaggaaagggccgacaccatctctcgctcaaccaaacataacggcgtattatgaggccaagatggagtcaggaaacccggtgcgccaatgctccgcataccactgctggagagtccagtgagccttcgacctctcagcaagaagacatatcacaaagcgagcacagagtgaagacgcttcggtaaccgacacatttctcaacaagcctaaaaagtccacgtaaaaatatatgagctgtttctccaagccctaggtcccagcagctgcttctcggtttgcttaaagtgtgaggttcgtgctctgcgtgccttgcctgcgaatatctctcggctttcgtgttaattcattttcgccttgtgaatgatatgggcaaaaacttattaatcaggatcaggatcggcggcgccacctccctttgtagcttgcagaagcgagagagatagagatagtgggcggccaagggagagagaagtacaagggtagcctcaagttgtggccaattggtcgtcaacagaagtatccaatgaaatcacacaaaagcgtggaagaactctggcaatgacacaacttccccgatcccagatcccgtacattagctcaaagagcaagcctactaacggaattataggttggtccagatcgctatatggttgtcatgccttcgtttcttttttgcttacagcttcatgcatgaatttagcgtgtgtttgcagcatcgtgctgcctggggcaggggggagggggggctgcaacacgataatgaacatttgtccttttctctgctcttgtgcttgttcatcttgcacgccaaagaaccagacctgtgatgaattatacgttctttatttttctgtttccttccccgtcttcatttcgtccctcgttcttggtttttttttttttctactgttcgatcgtttcatcgttcattgattagaaataggcgatcgcataatttcctctcccctccaactcctttcgtttctgctgctgcttcctttttttcagcatgtagctatatttttttctttgatcgggtttatgcgcttcctttcagctcttgcgctgcttgccatcgccagtgtgtggtgtctgtccccttctgtgctctgattttttttaaactgaccgtcaacccgagccctgtgcagccaatcagctcgcgagcagagactgcaatgacgtatttcaaatcactgtgggcctctttgcgcttttctctttcctcccgctttgcacactctttttttttttcccctctcacccgcaacgcttttccagcatcctcttcgcttctcaatccagctttggctctagagacagacatcatctgccctatccccattctcaaccagcataaaggacaaaaagtcatcaccagtgtaagactacaaagacgagaaagagagagaaaaacaatagccatccctccagtgtctgggacctgacctcattctgggacatcagtcttaccctttggaagcacttgaccgccaaggcgggccataagagagggtgctaggtgtgggggagatggggaagaacaaacgacagacaacaagagtcgtggaacaaactgcgcacaggtagcctagtgttcgcttgcgggaaccaggagttggctaggctgtgatgtagtctcatctcggtccatggccctgctctccggtttcgtcattgtgcttcgacgcttgtatacagtcctcccactataagtcaacggacagacacacgcatattctatctgcactctctgcacttggcattctccgcttgtttcctctgccgctgtgctggggggccttacaggcctccctttggagcgtttcgacctgctgcattcagtgtcattatatcatggtcttttttatctttttccttttttttttttgcacacactgctcggaacacctcctcgaacaacaggcacttcgcctacaactacatcctcacgcgctcttgaattcccactgctccgactctttctcctttgctgggtggtgttgactagtgtgctttcttgccactaaccgttgctcttacaacgtttattagccttagtttccgcctgacaagctctcgtgaagcgacctgcccccactatcaaaagtatccgaaccagccaccgattgcacagcatcctaccatgaccacagtcggaacgctttctacagaccttggtcccggcaatggcgacctcacaggcaagaccagcatgggtacgttgaatgaatgcatactcgtctctgtagctctatggcatgaatttgctgcaaaggctatgaatatcacccatgcacgcctcccttgcacatatctaagcccttaaaactcttgctcatggctagatttgccaattgcacctgacaataatgtccctctcatcgtcaccacagctgccgatgaggacaagactgataaacttgctgtggcacctattaatggcgaaggctccatcagcttccttcaagcttgttcaaagcttgacatggaacccaacccgttcgagcagagcttctcgggcctgagctccgacaagcctggcgcgccgccgtcggccgcagagccggctgtggagacacccaagccggttctgccgcccatcgctgccatgtccggtcgactggcccccaatagcgagcaattcagctgggatgcgcagtctcttcgtatgggacctctttctccatccatgttggaaggccctcaggacccagtcatgtttgaaaaggccaacaccaatcccatacccgtcggatcgtttcccgcaaccgcagcagcgcccatttcgaccatctttacatctggagcacctttggcagagactggattcccgtttgtgggcatggctgctccacaatccatggcgccttctgcgggacctatccagacgaccgagccgtatcagccagccatctacaacccatctggacccaacgatcgccagaacatgtcattcgcgcaagccaacggtcagtctgctatgaacgaccgttatatgcctcctcaaggagcacccaatcacgatggtggagcaaacggatatggtaacctgcatcttcttagccaggcgcaggcgacacaccgggaaatgtggatcaagcgagagagcgtggatgccaatggccatgtccattctcagcacccacaagcgcagcatgctcactctggcgcacctcaaaatggccaggccatgtcaggaatgcaccctggtatggtgacagcccagcagccgcctaggaacggagccgagccctcgtccaggaacaaccatcgcaaccgcatgacttcagaagattacagcgatgattcggagcagtctatgcagtccagtaccaatggcgatagtaaatccaagaagggtaacggccacaacgataagaaacggccggcgagcgatgacaaaatggacgaagaagaaaagagaaagaactttttggagcgcaatcgtcaaggtaacactttttttttaaatcgcggttgagtttttctattcatgccaaaggatcaatgcactgaaaaggcggtggtgtctgcagtagactcatgaggctcacaatttcaaacacatctcttcaattttagccgcgctgaaatgccgtcagcgcaagaagcagtggttgaccaatttgcaagccaaagtggaatatttgacgacggacaacgagcacctgcagacgcagacggcgtcattgcgcgacgagatcattcatttgaaggcccttcttttggcccataaagaatgtcctgtggcacaatcgcacggcgtgtatgcagagacgatcggtaatcccagtgcaggaatgatgccacacggacgaggaccagctcattctatgcagggacagccactacagcatcagcagcaacagcaacgaggctcaggacctcggggtgctcttcctccgccaccaccgccgcagatgcaagctggcggacaccggatgtcgatgggctcttcttcagcagctgcagcgggatctgcagcctctgcagcagcagcaggtgtccaccgtcccatgtccatgatgcaagatatcactcccaatgcgtctccgagccaggcacaggccaccgtacggtactgagaaagaaaaaaaaagtattttatagtcccctccttcaacttcgcctcctcagggctatttctatctccctccttcttcttcttcctgtcaccgctgcatctctttttctcctcgtgtattctactctctcggtctctttttctctctgcataccttcttttgcatacttttgcaacggacgaaaaaagaaataaatatgtattcaattcgaaaaaaaagtgactttcccatggaagtcgggggttgttttatggttgttggtatactctaaagggaaaaatgcaataatgagggtgtggtagaaaaaaaaccgatgatacaagaaaaaaaaaaaaaaaaaaaaaaaagcgaactagtctctgtcgggtgggtcaaacgaaaaaacaaaaaacaattacaagtgccacagctaagcaaaaaaaaaaaaaaaaaaaaaaaaaaaaaagaacaaacatcaaaaaaagaaaaaaaagaaaagattccgccccttctatgcgagagggacctcttccatgtccacgttgatcttgtccgtttgttcaaagactgaggacatacttggctcggatcctgacgttggggggctcttgatcgacaatccttcgacggccatagcctcgggcgaggtcggtatcgtagtggccgagaaggattcagtggtctctacagaggagcgaccttcgacatgagcgtcctttcctattgagacgagtgtcgttgtggacgtagaggtcgtctgggtagtcatgagcccttgctccatatcatcgtccacaagcgtcgaggtcgtggtcgtcgactccatgtccacctccatctcgatctccatgccgtcctcgcccgtatacatggtctcgtgctgatgacggtatcgctccagatctgcatgcgagatatggcgcgtggtgccatgactgagtgaatgatgagagtgaccatggccactttcaagatccagatcctgctcgtcactgtccatgttctcgccatggtgatgatcaatatcaatgtcgtcgtcatcctccgagctgctaaagtccatcatcatcagcttacgcctcctcaacgtccggccatggctatcctcctcctcctcttgctcacgcttcgccaacatctcgtcgtcgtcatcgtccgcattcagatcctcgtccgaatcagagtctgaagaagccaagtgagagggatgatattgctgatgctgatagttgtagagttgttcttccgcatccttctcctcatcatcgtcctcctcagattcctcctcatcttcttcttgaaagtattggtcgtcgcggctgaggcattgatttgaaagcggggatttcggtcttgggaaccatgcttggacttccttccagctcttcaccctggtcactttttcgggcagctgctggccatcgccgagtttgttccacttgtaggcgccctgaagatcaaagaggaggacagggatgccggcattggccacctctgtggcgttttcgagcgagtcgtcgatcagaagctgggcgtggacatctctgcaaatcacggactttggcttggaaatgaaagtaagtttctcttcctcggtgagaaagtgattggcaaagtagatggactcaaagattcctggaaagtggcggtcgacaaactttttggtcagatcggcgacgaactgctggcgtgccgtgacgatgaccaaactgaagcggcgggctttgagaagctagtagtaggggcgtgccaacataagacaaagggggcaaagaaaaagagagggagggagggagggagagagagagagacaattgttattaaagtgggggtggatggttgattattttgccagccggatatgacagcagtgttctttgtaaagctgcgaaacacagggcgcagacagacattcacaggccaaagggaaagaagaaaaaattgtaggctccccgccaccaatgcaagtccaaggcagagcaaacataatcaaaggaatgaaagggagcattgcgcccagcgtctcttcctcagatcggattcaatcagtcctgatgttgtttaccttcagagtctctagactgccctcgacaggctcgaccttgaggaagtagggggaatcgaaaaagagcctccactttgcaatcgattcctcccgggtgccgccccagacctgggtgtagtcgtacgagacaaagtcgtccatggtcaggctggtgccgtaggtgtcgttgtgaaagtcggcgatagccagcgtggtcctagccaggacctcgtccaggtcgacggcaatgaccttgcgcggtgaattgggctggtggcgcattgttgtgcggctgtgtttctccctgagatcaggctggcgatcgagcgatccaacgagcaaacgaccaaggcaaagtgggcggagtaagagagcgagaaggcgggacgaggaggaaaacgatctgtgggaatgagaaggcgcaagggacggatttaagaacaagagcaggcaatgggcgtgggagataagagaggagagcagatggacgagagaagaatgaagagaggcgggagagcactggacagcgaggagagctggggtggagagtgcggaaaagaaagaaacaaaagataaaagacaagacaagtcaggcgagaaggacaaaggcacccagagactgaacaagaaaaaaaaaaaaaaataagaaaaaaaagacgttccccccccagtggagaatgaaaaaaaaacaaaagttttttttgcttctgttcgctcaggcacgatcagtccgagcgataggcaactcgtttgtcagccagtcaggtccagtcaaatccgtcgttggcttgaactcaatacgacagccaactcccctccgccttgaggtgttgcgttgaagagaatgctccgttcggtccactcagcacgggtctgtcggtctcaagactctatgtttctgaggattgttgtatgcacatctgcatccaatacgtgttcttgtacatacctctcacatcaagagccgtgaggaaccataatcgcaatggagttgcttgaatccaatttgattctgctctcgtggatcagctctgatcctccgtctccagaaattacagttctctcccatgtgtgttatccattctctcacgccctcgcacacacgaccatgttcacttcacatgatgccgcctgcggtgtggctggcaaacagaaaaaaactatgtacaaatatcacacgccccaacgggcagcatgcagaagtactgtagcagcagggggaggcgtgtggttgtgcatctcagggtgtagggtgtgattctattcgtaaccgcattgtgctcggaagcaacagccgaggaaagagatcggggtcccctgtcgactcacagcacagcagagcatgacatggaacatggcactgcgtactgtacagtcactcatacaaaaacatctgtgataagggcacagcatttgcaagtgagcaatcgtttgtatccttgtactcgcaactttaccttgcacaggcacgcaacgttgcacatcgcacgacctaccatcctttatttttctttcttcttctattcaattcgcaactacaaaatggaactaaactatcaactgtcaacggtattcatgttcagcttgcttacgagtgaaagagcaatgacgggtcacaaaaatcgaaatacaaaaagatgaagaaaaggtcaacagacatgtcaaaaagaaagagaaaaaaaagaagaaaaataaaaaaaggaaaaaaaggaaagaaaagaaaagaaaagaaagaaaaagatgcgaaaagatagttgttaagcgttcgaagccatcgaaccaggtccatcgtacatcatcttggcctgcacgggaaagagatctctcaacagctgttgaaacccatcctgaattccagcaccataagacgttcggtctgcatcacgcaggatacgcaatgtctttaacagattgatcttggcaggtgtcgagagcctgggctcgtcatccaagttggcgttcatcagttgcactcccgctgcagtcacgagcgagaactgctgccgcatcagtagacatggctggagcgtcaagtctctctggttcagcagagattcagccaacgaggtcatcgcatttgcagactgcgcacacacggcacttgctcgagttggttggcatggaggatggcgaagattcgttctcaaaaagggtcgatagagcaggatccggatggtgtgaaatgtgatccccaggagagttgactgcaccacatctcgcccctcttccgcgttggtcaacgtcgtcacaggcatggtcatccctatagtctccctttcagggctgccaagcttctgctgatcctgctgtcttgactgttgtcgcggctgctgtgatgtcgcaaaaattcctgaaagtgggaacgactgccagtccgccaaggactgataccattcgtcaagcccgctactcatcttttcaaactctgcagtactcacaaagagatcctctgaccaagacgaaagaaagcacaagatatcatccagaagtagcgcctgtcgacactgctgatcaaaaaacgcctttgccctgaactgtgctcctggaagggacgccgaggtgctcgactgtgcaccacccccgatcggtcgcatattaacgcctccgctctgctgcagagacgacgtgagggccgcagtatcaggcccccctggagtcaaccaatagtcggacgttgaggatgtcacagccgcttgggtcgcatcatcgtccttggactttgaaatctttagaggcttgggaagtggtcgaagatgcgtcttgtcgaagatatgcacaggtatgttctacatcaaaaggtcgatatcaaacattagagcgtggccagttgcagcaagggcgcacaatacaaccattgagaagcataaaccaaggaaagacttacaactggacggttgtaggctgcagacatccagcgatcgataatgaagcagtgccaccagcacaacttttgctcttcgtcaatgatcttcttctcccgttgtttctcccgctctgccttctcagccccggattccataccggcgggtaaggggttgctagtcacttcgcggctgggagtctggactagatgtgcatggtgccacccaagacccatcgccattgtgattgcggcgcctccgtacatgtacgcttgcgtgtgattgcctgccatgatggcgtattctcgcagaagaagcattgactggacgactgccagcgacggctcctcgtactctgccttcagaagctccgttgcccatagaaaatactgctctccgcggtccaacggattttctgcgctgccgctcttcccttcctcgtccgtttccatcagctcttcgagacgggcctcctgggctttcaccttgcacctgctagccagtccgccctccgtcgcgaggccggagccgatcaagcccaggctcttttccaatcgcctctgtttatccgtggccgtgctttgtaagggtgtgcgatcgtttatatgccgagcgattaacgcaatcatggccatcagtaggagtgggctgcagtcctgagggttcgaacggtcgtcacaaggcttttgtccctcgccggagacaccctcgatcgagcccttccatatgttctccggcgaggcttgatgcatgatttggaggtggatgtcctttgcctcaggaaagggtccatagactgcccagaatcggacgaggaaatggtttttgtggaggatcataaactgcgggtggaccagggtgaagtactgctgcaccaagctgtgcagcaggcctgagcgtcccagtctttgaagtccatcgatgggggtcgaagtgaagatgccctcactgcaggaggtgcttgaagtggaggggttgacgaggttgctgcccatagccccactgctgtcgagggtcgtgttcgagagggaagtggcaagcacttgctgcgggtcgctgccctgctccgtcatgtcaacatccacggactctcctccagaagcactggcctctgtcgcgttggagatgggcccctcgtcactggtagcgggctgcagtaaagttttggtcttggctacaaagtccgcgtacaagtggctggctcgctgaatgttctccatttccaacgcgttcttgcgtgctcgaatgctggcactcgacagggagtaaagagggtccttcgggctgtggacaggtagaggcgcttgtttcttcccggaaggtctcttgacaatagagtcaccgtcgatagccaaaccagaggcgaggccgctgtcatttggaagtgtccgtatgcgactggaggatccttgaacagggaggatcggacgctcaccggttagcttggaattcgacctgtggacttgtggtgagacctgctctgctgcggtatgcacacaatggggtgaacgatgagaatcaatagagcgatgatgaactaggcgttagtctttcaaagtgagacatggacgagcgtgaaagagcgagagagaactttctcttagcgagaaatcgagagccgctatactcaaaaagtgacagtcgcctacctgagtgatgcgagggtctggtcgatgaggagccgccagtcctacttgtggacgaggaccgcgagtttgttgacgatgcagaggatagggacgcagaggaccggggcatgatggacgagtccattgaggatatggaaggcagggtcactttggcgtgctgagggcggtcatggtgagcaaactcttggaagggggggatggatatgagggactgatctgtgagctggatggacggagatatcaggggcgagactcgggggtacgattgctcttggccgttccaggtcatggaggaagcggagcctgagccggatctcgagcgagagcgcgagggattgggtggggaagtcgtatttccaaacttagaaggattgtcgggatcgtcacgactttcctgctgaatttggtgctcctggtgtggttgctgttgttgttgttgctgctgttgctgctgctgcaaagttgaggggtggtcgagctggagtgcatcgatgccaaagaagcgcgtgttgttgtcgccatcatagtggcatcgaactctgttcacaagacaagggccacaaggtgacccaccgtcgcatggctttttggccatgctacaggcaaggcagggctgtcccggcacctttgggcgaggaagccacgttgctggctcggcgggttcggcgttagggttcctgttagggttgaagcgtactgaatggctgtgctcagacgacatgcttcgacgatgcgaacgagtcgggccctcctggccggagggctcgctgtggagacggtgaggggcttttgagccgtaggtaccaaagggatcgttgattaatggacgataactgtccaacacagcatgtcctggattcagctgaggctgctgcagttgagcctgaggttgctgtgggtattgttgttggtttggatatggcagttgcatgaagtgttgatgttgcaactgttgttgctgttgttgttgctgctgctgctggtgctgctgctgctgctgctgctggtgttgatgttggtgagcatagtctaaactctgcagccggaacggagtattgatgcccgcgttgctggcagggttgctggcagggttctctgcagggtaggccagaggcgcggacgagggcgctgactggtttgggtcctggaaaaggtggttcatggtgctgggccaaaagtagatcccacgcggagcaatgcaaagcagagcaaggcagagcagtgcaagacagagcagtgcaaagggcggtctttttgagcgggagtttgggattgagaccgcaaagtgtcacaacgcgagatagaatggaaccgcagacaggtcgatgctgtgggaatgcagtggaaatgcaaagtgcaggtgcgtgatggatgggcaggtgtggaatcagctattgacataaacaacaaaaataaaaaataaaaactagcaaagagagcgagagcgagcaagagaagagagagagagtgggagtgagagaaaaggaacgggcctttctttattcagacagtactattttattcactcttgcccttcgccaccccatcgactggaaaaaaaaaaaaaaaaaaaaaaaaaaaaaaacgctaaaaaaacaggttcgactgaaccgcaaaattgaatcgagcgagcaatagggctcattttgatccccctccatcgccgtcatgtttagagagtcctgaccttctccgaccacatatgtgcaccacacacgtatcgctctcccttcctcgcctctgctccgctttggggacgtagtcttctcaggataaagctctgtctgcagcaacagcaacagccgtcatctgtctgatctgaagatggctcccttgtttcgtgtaggatcagcgcagaggtactacctcgtaaacgggcagcagctctgccttctacatggcaaacacaatggagcaataattggatcctctgcttgatgctgaccgagatgcatcacctcagctgaggaagggcgagaggtggcaaagacgcctgcaggccagtgaataatgcaggcgacttcgatcggatcaaggtacggacgactgtgctgacttagtctctttcagatcgttcgctctcttcgactaggtcggtatccgtaaacagcttggggcatcgtcgctgaatagttgcaagtaaggtgatagagggtagcgagcgagcgaggatgagatgaaggaagataggatcgaaaaagaaaaaaaataggtagtgtgggaggaagggcccttctacactttggtctttgtccaccccctcgcgagggctgcaaagcaacagaggtccaagaggagccaagggatgctttctgagaggactataggcccgtctcatccaatggcagcacagtgcagtcacttgacgagcgcaactccgtctctgagcctctcattctgcagcgggtctttcgtccccgcccgattattaatgtgagattcgtatgcacttttccctcagcgagggatcggtagccactggtctcttgaaattgtctctcatatatagtaggttttgaaatggttttagcaattatgggttcccccttgaaagaccactcaatctgaccagcgcagccaagccacttcctgccctgccacgcttctctccactggcaaggctcccctccgtagcattcatccgctctccccgtcttttgtctcttttgagtcgcacctgccgcattcctttgttcgaccttctgcacacacacccgtcctcggaccagagagacagccagcacactcttatacacgcacaccccccacacactctctcgctctcacacacatacgcacacacaacgcatgaaggcgtcagcaggatcgactgccacgcgggcagcagaatccctcgcgtacctcgatgactatctcgacagtaagtgtggccttcttccacttcaacagtcgagtccctcatcgtcctgttctctctcaccagcgtcactcaacctcagctgatatccaacgtctgtctgcaaacagctgtcgagtcattaccactggaactgcaacgccagttcacgttgatgcaagacttggacgccaaagctcaatgtaagtaagctccaccaaaaaagtgtgtgaatatattttttttttgtgagagtgctgttgccctgcctgctttgagcttggaatgcaccaccatggagcactgctcttcaaagcgcaaacggaaatagccattaacctacacgcgttgtgaatctcatgacccttgtctaaatcgacttagccatcatggcctccgtgggtgcgaaagcaggcgagttcattgacaacgttacagagctgtctccacaagaaaggatcaaaatgcttcagtccctgaacgagatgctcgtcgagagcttgaggcagggcgaagaaaaggttgcacttgcgacagcggcgtacgacgttgtaagtctttattatcctctgttcgttttgatgacgatggccgctagcactttatactgggagtcttccctaagacatactcggatccatcttgactggtggccgctcactcttatgtatacgcggtgggattcatatctgacggagacctctatatgtataggttgatcgacatgtaaggcgcttggatgacgatctacaaaagtacgaggatgagcaaatgattggaccaggacgacttggtaacaacaccacctccgcagcctcaagttcagccgctgcagatcgtaaagaggactcgtccaacgcggccgcatccagtaccaccacctccaacaaaaaaggtacgagtcgcccgtctcctttgatcaccatgtctgacatcgagaaaaaaaaatgctgccggcgtagtcgccgcgactgatactaatcgttacctccgcgtcaatcgcataggagcatcctcatctacggacaccccatcatcaaaacgtaagcgcaggatgtatttctgaagggaccttgcatatgaattcatactgggaagaagatcagggactaacgtcgtgtattgtcttgctattgaactctcagggaagaagcacgcacacggcaccaacaacagcagcagcaatgccgcaaccccgtcgtccagcactacagacaaacgcaagaaggaaacagtggcaaatacgggtggatccagggtcacgaagaaggcgtatgttacgaagaaaaagtttacacctcggattttatgttacagcggcaaggatttgattgactgtgcgctgaccctgtctctgtcgcccatttagatcgtcgtttgcagagttaccgatcgatcccaacgagccgctgtactgctactgtcagcaggtgtcatatggagaaatggttgcctgcgacaatggagatgtatgttatttttttttctttcgttatatactctaccgctaaggagtgtgctggctttttccgctaactccttttcttttctttcttgtttcttcactcatttcctaaaatcaacgcgcgtatcatgaatagtgcgaaatcgaatggtttcatctgtcatgcgctggactcaaggcaccacccaaaggaaagtggtactgcaaagactgctctcaaaagtcaaagaagcctcaaaagaagtaaaatcgatgggagaaagagtctattttttgtattgccaattggacgagtccgctttttttcttcttttttttttgtcttttgggcgcgacaggaaccctccgtggtcagcttgtcaataaaaaaaacaaaaagaagttgtaatattacttttggaccaagcaagacacacacatcctcctcaaaagggtgtgcgagcgagcgagtgcaaagacttcacggcctcatggcgagcggcagtatctgatattgcgggttaaagaacaccacagcatgcggagaagaaaagcggctcctctttagagcgcaaggacaaacataactttctcagaactcaagagttgcaaaccatgatgttttattgtacaagtgagtgaaccgaacgttgaaaatgtagtttcagatggggatcatcgtgccaatgttcttgggcatgtactgtgggaagactaagggaccgacgatcagcatcacaaaaatggccatgagtaagacgaacagaattccatacagccatgcggtccgtcgacgttgcgcccgcagcttggtcgagaagataggcgcccggatttgcttgctgggtcgtagccagaacaacatggtcgaatgccatcggtcgatccaggggaccaggcagatcggaaacagcaagaacagaatgacatgacccatgataaagtcgcatgcgaacatggacatctcgatagttttgcagatatactctcgcaaaggctgtgaaattgcgtgtgttcccaaaccacggccatgccatttgcctgtccaccatgcgcgattggtctcgtcatgcttgaactctcgggtcaggaagacggcaatcaggaccttgaagacaaaccgttggacagcaatggccgcaatgatgccgagaaccgcatgcgaggtgttccaggcttccagcgcccaaagagcttcgaaaaaaccaagcatcgttagcactgcgacggcgtgggcgatggctgccatgactgatccaaacttgacacagcacatgttcatgcacggtccgatcatgagagagatgccgaagagcgtggccagaactgctgcgttcagaaagatgggtccgagagcaaagacgccaatgcggagcagcccgcttgtgtagatggcagcgccttgattgtcgacaccagtggggaaggagcggacgaacatataacagagcacgcaggcagccagctgcagcaaggggaagacgatttctgaaacaaagatgaccccaaagttggccttgggcatgtctccacccagcgtctcggatgggtgtccaaggcgcttgcgcttgtatccagtgatgcgggttcgaagtgtgcggcagtatgagatccaggacgacgcgtgaatccgggaattgccacgagagagccaacgcaaaaactcgcggtagtcgagcaagaactctgtgaaggagaactgatgagggttgaaaatgaatggcgagatcaccaaggctaggacagagacccaaaagtagatcaagtgagggacccacatggtgagcgaggcgaatatcagcatcaccagtgtcctcatcccgagataaagcgatggaccagcgaatcgcgaatacagcaacgcgaagggggttcttgtcgtggcaaagcctcggcctgtggcgatgtagcgcgcgcctccaaaggacaggttggtcaggatcgagttggtgtagatttgcgtcacaaatacttcgaacagtggagacagggacatgaagtgctttccgagacggaccaggctcctgataaacccgcgttccatgaactcttgaagaaataagggtaggaaggcgatgaaaaagacgataaagattgagagcacgcagcgcttgatccagtcgtacacaggaaccaggttcacgcaaccaagctctgcaacatcggtacagatctggaccgaggacgccatggatccaatgaacatcatcgagaacatgaacagttgcacggagagcatgataaatatgttgttgatgtggaatccagggtgggcgtagtaaaacgtgaggaatcgatccagtggcagctgtgttccaaggtaatagtactcgcgagagagcatctgttcgcccattcctgtgccgatctttgtgttgaagttgaggattgatccgaagcccaggtcgcgtcccttgccacactggtagtactcagtatgtttgatccttccaccgcgattgaaggctgtcatgccggcgtaaatgtcctcgttcaaatgcaaacccttctgtgccttgctaacacctgcaacatggataaaacaaaagttcagtacatagggaacaaaaaggaacgtagaactgctgagtacacgaatgagggggaatgcaacgcgtgtgcatagccaacagcgcttacctccacgggtcgtcatgaagatgaagttgaggaagtcgggatgtccataatgtagtttgccaccgatctttgccatcatccgctgggttagtgtaccaaatgtttgctcctttccggcggcaacatcgcctaggacaccgatgttctctgaaaaaatgtactcgcgggctccaacgatagcaaccggttccggaacgtctttggctgcgacctgaggcgagtagggtgagtgatcgggcatgtgtagttgctcaaattctccgaggacgttgcggatcttgagcgcctcctccaggtagttgtcttggttggcatcgaccagctgaaggtactcaccgcgcgcaaatatgactgagtggttttggttatcggacttgccatcacccaagatcgggttgcccggaagtcggatctggaagcggggccgacgctttccattaggcatgatctcgcatctgccatcgatcagcactgagtacaccaccgcttcctcgccagcgacgcctgacgggcgctcatccaggtaggcaatttgcaaactggggtaagcccgcaataaaaactctgcgttctcggcttcctccttgctgaactttgtgaaccgctgcattgagaccacgaacttgaacttctggttggacattcgctccagctcacgttccagacgatcgccgttgccaccaaactgttgtacagtctctgggttctcgatgcggtagagcagcttgatggccttggcgtagttcatgaaaccagagactgtgcggtacaatgtttgcgcacgaagagaggcccagatgcgcgtgcggatcgtaaactctggagaagcagacttgaatccaatgctgtagaacggcaggtcgtcgttggccttgtccatatctctatggcactccttgtcgccgcaattttcggacggtccgaacccgctgacgtcgttcagcattgctgattcctcggccagtattttggtgtccctcacaaagttgtcccactcaaccgcatgaagttgcttgagatattccaacaaagtgacgcgcgagtgctgatcctcctccctaataatctcccgaagcgacaacagcgtcttttcggagtaatgaggcacgagcaccgtgaaggtgggcatctcatccactggcaatggttctgggataggcgtcgacagggactgagcaaagaagttgatcctacgttccgcctcggattggcgcgggtagaattcagctttgatggaagaatctttctgtgccataaagaaggccggagccctgagacttgaattgccctcattttcgctaggaacttgttggtaaagcatgcgctgtacatgctcgatcgacaaaaggtgctcgcggtacatggagatgacaatggcgttccagatctgggagcagagtgcctttggtttgtacttgacgtccatatcagatgtggcgagcagcttagcgtagatgcgctttgggagctttgagatgatgttgcgccaaggggtccacaccgagattcccagcctgaaggagaggacgacggagaatatggtgttccagatcacgtaccagagatacgtgtcgagaaaaaaaagcaccaggtcaaccacaaacatgatcacgaccgtgaacaccggcataagagtgcatagtgtctgccctagatacttgtccttgcaattgggaatgcgctcagagtaaagtgccttgagcggaggattgaacgagcgtgcgagaaagaagtacgactccaccagcttgcatccaaagacgagggcccagagaaagattgacagcgcccgatcggatcctttcagtttcgggaacgaagccgtgaatgtctgcgaggccaagttcttgcgggaggactttgacatcccgccgaagagctgattcgaaggcacaacagcaaagacgatcgttgtgattaacgagacaccaaaatgggaaatgcccacaatccgagagaccgtgcctgtgcggttgaagagacagatgtacactgcgggcgccacattcatcattaggacgatgatgaggatgatgagcctttggatgagcatcgtcgaattggaccaggtgagggggatgaacatgaactcgcagaagacccccaagagcatgatcagtgtcgctatcgctccgccgagggctacaacggaccactggacaccagactcgtctgcgccttcgttggtgtagaggaagggggcgttgtaggccgtgaagtaccagtacatgaccacatggatgatccagatcctggtgaagttgactgccagatggagccatgtccgcttctcaatatagatctttcggaatgacgattcccaatcgacttgaccgagagcattccagcgcctgccgatgtggatgtcaatcagtcgcttgttatctcgaagatggattcgttcgatgccttcagggctccaaaatgcttggttgatgtcgtcgtatccaatgatagcattgtgatcgcgctcccgcttcacgtacttgccatcctgcaactcgtagccttgatctcgaatgaaccggtacaggggcgagatgatggtgcgaaggtaaagaccctcgggggcggggtggaccatttcctggcattgaggtgacaggtagtagtcttcagcacacttgtagatgaagcagaggcattcaggcaagaaacggatctgagaggcttcaccccagagcaagaggtagagcgccacctgccgagcacgatcaaaatgtgtcatctggttcatcttcatcttccagtggtgttccgccatcgcgagggactcgtgtgtctcaacgtcaacggccccaggttggggtgccatggagctgcggttaactttcttgttctttctcggcgcagagtggtagcccatgtggtcgtccaaatccaactgtgctgcaaaataccacttccggtagtttgcgttctctcctccaatgtagtctgcatggattgttgttagtgcaagtgcaggcgccatacgggatgccctcgagtccagcatggccatgaacgcctcggattgattccgcatgttgtctttctggaacccaaacttttttgtcaagtccagcatgatgccttcaatgtcctgttgtgttagaggtacgccctttgcaacagtccatgatgggtaagcgttggcgtgaggctgctgttgccgataaacgtctcggtagggatggagagtggcggagctgtcgtattggtattccaggccagctagtggactcttgttgtgttccagcaatgacaaaagcgcgtctgaggaaggcgagtagcccgtgtagcggccgtcgtcaggtcctctgaaaggtccgaagaggtcaatatcggcccctgcattgcctctgttgctgaagttgtgtggcgagctgacctcgtcggagggcgagtcactgaaggtttccgaatcagactctgatgacctttcgatgtgcctcctgccgctagcaagagcggtgtcgctggcgccgttcttgatggcatgcgcaaagggtcgggctcggagatctgcaggtgaagcgaggcaggtacgaaattgtgagtacgttgcagcgtagccaatgagataactggaaagcacgggtcgtttgcccaggagaactgcgaccaatgcggaggcgctgcaggtctctcacaagaagcacacgcgcgtgcaatttttttttgttccgatacctaccatcgctgtggtcagactcccgatgatggaacaacgagttctgggaggaggacgagtacatcgtgtctcggtggttggggaccccatgatgcgaaaacaagctgtcatcctccgattccattccattcaggccggcgccataatggtgattgttaaactggttcgacaattgcaagggatggttgacgacttgaccgggcagcccatttacacaaacagcctcctgctgtggtgtttgcaaggtttggagagggaatgagttgggcgagaagggctgctgggtgcgaatattgtcctgcgacggcgtatgagcagcaggggatgggcgttgctccagaatttgtcgagtcaaatttggactgtgtccagggcgacgagctggcctctgttgcggctgctgagattgtgacaatggagttgttgcgccgttggggttcgagccttgtctcctcccgattcgcggaggcagaagatcgtccggagcagatgcactcatcgaaatcacggcgctgtggcaataagtttgcttaaggttggtcctggcagtccgtacttggctattacagaggctaaagtgcaaacagcatttagatcggaagaaacgcgatgttcagcaagtgagctcactcgtgctttcacacccacaccaagcaaaactctcttgaggcactggagaggctccatcagtccatgacgaagcaccaacgcttgactttaacggcctccatgatatactgtgggacttacgctggatagtcctagagtcgcccggttcgctttatatgatgtaggagcgcgtttgttgtttaaggcaaggggaagctgcaacaggctgccgtaaacgaggttgtcaaaagagaaaagtctagcacaaagaaaggcagcctcgcggtcagtcaagacgcaccgcgtatcgggttctgaagtatgccttcacggaagtctgtgtatgataactcctacgcactgtcagggcttgtatgaaagtgagggtacgtgaagtacgcaacgtcgagcttgcgctggttgcggtcgcgaaggcttgctggcgagaaggaggggtgcgatgggatgcggcttgtcgaggatctgggcagtgagagaagagcgagcagaaggggcgggtcgtctgttagcagaggggaggtaggtgaggaagagggtgctgtaggtgaggaaagggaagtcgaggagggtgaggaggaagagaaggaagacgaggcgggggaaggaaagaggcaccaggacgacgaggctcggtgacaggcaagaaacggggggacggaaggagacaaaagagacgagacagaggcgccagggtggatgagggtcttttgcctggacagcaaaaaaaaaaaaaaaaaagtaagggcaaaatgagcataaattgcgtttgttctctcatgctgtttcggcttgcgcatatggtcagagactccagcgcgttggccaatattgtatgatccgtcgactcaataggctcaggcgtgcccatatgaagagtaggacagagtacctctcctgtatgtacctgcctgccctgcgacagtcgggcacagaaacagacatcgggcacaggaacagacatcgggcacgagcaaagggaaaacgacagcgcgagacccgctttgaaaatatgggcaaatagagttgtgatggcgaccgctggccctccactggtgcccaaacgcacctgctttaatcgatctcatttctcatttcaacatcagaagcgcccggtaccgaggttcaacaccactttaagtttatgtttccgtcaccgtgtatgtcgacgtatacggcccttgcgaacgctgggtgaaagagactaccagttgatcagatagcatctgaagtcagaggtcattgtggatgacacgcctagcttctcctatttgcatgcgagggtgaggattgatcgtctcatgggagatggattggtttcgtgaaacggtgttgcgagggtgaagacacgagcctgttctgaacatgagttccttcaggagggtgtcactgtgggcggcgaccaagagcatggacttgtaaacgatgattatgaaagtgaatactagtctgcacctcaccgaacctttgcagggacaaaagtgttgaaccccacgggcagtgtgtgctcgccgcgcgccgctgcccctgcttatctcggcttgaacctgaacccaaaagaagggctgcagtagaaaaggctgtcatttcccgtgtgaacaagagcgcccggtgctagagggtacagaggtgctgaaaatacttcggatacagcgggctttcatgtggataaagacatctccattgaccatggcacgttgtgtttcgtgctgttgtgctttgctgtgtgcctaacactcaatcgggcggctctccttttctgcccccagtccgtttgcaattagagtagcgcagatcactgggcgtttatgtttgtttgaacgggtttttgacattctttttgtgagcattcgttcttcttctatcccctggagaatgtagaacaaccgagataccatttgctctcgtatttttagccatgtaatagagtttcaaggtatgcgtccgctgggatcaagcgtggcaattccctcgcgcgcccttttctcttcatcttgatgctgctggagacgcacgcggtaagcaagcaagcggggccttgcctttgagcatgggcgtactttgaggcgtgctcgtaacctgaagcttggtgaatacaggtctgcttgtcctaaaaataggacaatgaaggcactaggaatggcggttgtttatcctatgaacctcagtgtggacgcctgcaagcacatgtatagctcgcacaggctttacgtgtctatacggcgagtgtggatgtatgtatcaaagacacgcatccggggaatcttggctccgacgcatcggattctcgctttatgtctacgtgatctcagtgcggactgacgagggctacttgggatggaacagatattggccaccacgacgctcacgggctccgttcagcgagggttgttcctggtcactgtaaaaaagctaaagggtctttgtgcgattcccgttctcaccagacggccgcgcatacgagcaagcatacgtgccggttcttgacgagatgccaacgcacgccggggtcgctttaagtctcacaaccatcacctacatactttttttgaaaatgccagccctcttgcctcttagctccggtgcccactgatctcatccagcttcgcacacttttgatcgactgacgattgtctcacacgcactgagttcatctcgggcatctttttttccgctccttgtcttcaagcacagacgcagtcgaccatatctcgttatgtcgcgactcccggcactttgcgcggctgttcttgtggccagcctctcccttctggactcctccacagctttaaatcccatctccatcaagggctcaaagttctttgactcggtcaccaaggaccagttcttcattaagggcgtggcgtaccagccccgaggtctcaccactgagtttgtcgatcctctctcaaattctgcaagctgcgggcgtgacgcggctctcataaaggatgttggcctcaacaccatccgcgtttaccaggtactgtaatccttgaatcacccctttcgcgcctgatgcagctgcctctcacaatgctcgattcccctggtatatattcttgcctccgatatcagcgattcatcgtccgactgcatttgaccatggcaaagtccattcttctgattcacaactgattttactcaactatggattcaggtcgatcccacagcaaaccacgatgagtgcatgaagcttttcgaggacgagggcatttacctattgctggatctaacgggacccaagcatgccatcgtccgcaacaatcctgagtacaacatcgatatattgagcaatgttcagaggaccattgacgccttcaaaggatactctaatacgcttggattcttcatcggaaacgaagtgacaaacgataattcgacgacggtggcgagcgcatatgtcaaagcacttctgcgagacgcaaagacttacatcagccaagctgccccacgcaaaatcccagtcggctatgccaataatgacgaccctcgcattcgcctccgcattcaagattactttaattgtgggaacgtggaggaggaacgcatcgacttttatggcatcaacctgtacgagtggtgtggtcctggggtgacctaccagacttcgggatttgctgatcgcaccaaagaggtagcctcatattcgattccggtcttcttgtcagaatttggatgcaatcttatcacgcctcgcacttttccggaggtcggtgccattttgggatctgagatggcaggcgtctggtccggtggcatcgtctatgagtggactcaggaggccaacaagtacggtctagtcgcgatagagcccgatagcaccgtgacacccttaccggactatatcaacttgaaatcgatactcgcgaccacccaccctgtgggccttaaaatggacgggtacaatgaagagcgacccgtctccatctgcccggcgaccacttctggttgggagcctaatgcacgactaccccctactccgtcggcttccgtctgcgagtgcatggtatcttcgttgggctgtgtggcctctgatcaggctacatcggcgactgagaaaatcgggtcgctcctcaacactatctgcgggatgacctcgtgcgatgacattagcgctaatggcaagactggagtctatggaaagtactctttctgcacaccggcccaaaagctttcttacatgtacaacctctatttcacccatgttggaaagaaggcggcagcaacctgcagttttaacggtatggcgaagctgtcggctacctcaagacaatccgatagtggttgctcggcacttaaatcaggaccagggtcagtactggggcccgggtcaggatcgaagacgagcagcatcagtggatcgtggcggcagaagcatagtcagctcatagcgtgtttcgtagcggttgtcatgactggattgggcgcgtaaaatatgacaaaacgcgactgtggctttgctagaccgggcgtctatttgtgccgtcgtgctgcaatcattttctctttccttttcaaacgaaacgcaagcaaaatggcacgtgacacgtaacacccttgcgcattcatccatctggtgggggtcggcaacggatacggcagccaacatcgacagacatccatcaggccagatggctgaacttccgtgcgacccaacaatatcaactggatttcgggacttttgatcatccaccagatgcctcgaatggagaatctcatcaactagtctctcagagaaggattcgcatgaacatcgattttgcgcggatcgggtgcggatggcaggtgctcggattgcggctgcctcctattgcccaacagctgggagagtgtctcgaagtcgaaggcttactcgggctatttttgaggaacttgccaaacaccaccctccaggagacgggaaatggactcaagggcaaactgggaacttgaccccatcaactcgccctgcttgagtttctgcgcacggcaatgagctacaacgacaaatggaggatgtagatcaatagcaatctagcgttcgccaaacggcaaacacgtcgtgtcgatatgttggcgcagacgttcaatcggcaacgggaaggaggactataatattgtcatcagggtgaaactaacatcagttcaccttttatactatttgttattagttggctgttgatctcttgaacccttcccacgctcttgagcagaagacccacaagttgaagagacttgtgcagtctcccaactcctacttcatggacgttaagtgccctgtaagtcgctcaactaagaactgtgttgtcaggatgccgcagcagtggacgaccacttccatcgtacatacgtcagcaacagtaccagcgtgcccgttcgtagccgtgtttcttgtattgttgcaatacatgagttcattacgggattgtagcgctggaaagatggcgccgtagactcaccaggaaccaccgccttgtgtggtgccgcagcatgtgcaggcaattcgacagcagcccttgacagcctttcatcaccatggccaatatccttcgccatttcaagctatggtgctgccgcgacagtgaccatatttcagctcgggaatatagtcaacaagagtatcactaaccaattctcctgacgcattgtcatgctttccatatatcacagggctgcgtccagatcaccaccgttttctcgcacgcccagaccgttgtcatgtgctcgagctgcgccaacgttcttgctcagcctaccggaggtatcacccgcttgaccgagggtaagttggcaacatgtttagcggagcgatggttctgttacgggaagtctcttgcactgaaatctaatgcttttgtctttcaatttatccataggctgctccttccgccgcaagcaggcttaagcgcttgtttgacatatattttgacacgcaaataaaccagctggaacaatatgcgagcgcattgccaatttcacttcgtgctgtgtcgttgtgtgccatcctgtgtgtgcctttttttcagggctggatgccgtggccagtcacgtgcattgaacctttatgacatatccaacgccctcaatcaatctttaaattctccgagcaaacatgaagacatcgacgatcgttgcggccacggtgggcgcaattgctgttgccaccgtcggctatgctgtgtactttgacgcgaagcgaaggaatgatcccgctttcagacgcaagttgagtaagtttcgtttccagcacttttcacaacgtcaagctgtctatcattctttccttcgcaaatagagcgtgtattttccgaccacgggtcgataacggtggctaatctgcctggctcgatggccactattcgacatagaaaaggagcgtaagcgtgccgaaaaactcatgaaggaagaggctggcaagatatcgacgcagagtgcacttacggtcgaagaagctttggccagtatcaaggacgaggactttccaactacgatggaagagcgcgagaagttctgtatgcagcaactctcggccggcgaggctcttttcacaaaaggtatcgatccctctgtcattcgtttccttatcattgtagacaacatatgtcattttccggtagtacacactgtgcacgtcctcaccgggccctcaaatatgccttttttttcctatgtgaaggtcgcgatgaatacggcgcagctgcgatttgcttctacaaggcactgaaggtctatcctgccccagccgatctggttatggtttatcaaaaaacgatccctccagaggtcttcacagtcgtgatgggaatgctaagcaaggatgtaagttgtactttcttgggcccaaccatttctgtttgctgaggcgagctgaccaaatcgctcttgcttgacaggttcaaagtaagcaggaaaagtactacaccgtttttcctccaaaggacatgtgcgtcaaggtcgtagagaagtctgagaacatcactgcagacggacaaaaggtggtgcagcgcggtttgtttgtgaccaaggactttgctgcaggagagtctattttctcggaagcaccagtcataagcgccttggagccatcgctggaaggcaaggacttttgccactattgtctgaagcagattgtccctgaggaagccaaggtcccgtgtcccaagtgcacccgggtggtattctgctccggagagtgccaacaaaccgccgcggaagagtttcatgatattctttgcgccaagaatgtcgagaacgatacggcgacagcggtgcaggacttgcaggactatacaaaggagacccgtaagttagtgccagagatgctcgccaagttcttggtcaagatggtctacgaagagtcgttgaaccgcggggaggaatacaattcgtttgatcacatggaacgacttcgttatctggacgtgcctgcctctgcggaggaggaaaaggagatcgagttgctgaaactcgctcttggatccaacattcccggcattgacgaattcatcaccgaggagcgctatcttctcatgaagggcaggctgctgtacaacagctacgccatctccagctctctggacgcccatcgtgaaattcaggtacgcctctgacaatgtgtcatgtcaaaaaggctaaaagagggagtaggcaactaaaatctctttgcacgcgtccgtttagaccatgcccgagagacagcgaggtgcgcatgaaggccctatcaccggtgctggattttatagagttatctcttacgcctcccactcctgtgagcccaatggcaagcttgtgttctcggagcatagccataaggcgtctgttgtggcgacgagagatgtcaaggctggagaagagctctttgttggctacattaacagtgacgcgctctcgaccgatcagcgtcgcctggagctgttcacaaaataccgttaccagtgtatgtgtcctcgctgcgagaacatcgattagacacgcgaatagtcgcgcgagcaataaaaagcgtttcggtatgtgactttcctgaacccattcccactcttcttttccctcgcagttactttctgcctggtgatttgccttgacctttcttcctccatacctcctcttctctgccttcactctttttacgcagctcagatatgggatacgaatacgttttcattgccgccgccatcatcgtccctttgggcatctttagtatcttcaagggtgatcaagctgtagcttcggccatcggcgaaaagaaggcatccttgcccggcgcatttggcgactcttccagcagctcaaagtcgaaaaagaagaagccaaagaaaaagaacaagggcaccaccacaacacagacggaccaggatgaaaggaggcaggaatcgtctgaatcagagattgaagagaagccagctgctcagcctccaaaaaggaatgatggcaagaagggagcaacctcttccctctcttctgccaacaacaccaccaaaaccaacaaaaacagccatagcagtagcggtgccaaagcgaccgagagctcatccaagtcatctccagcggcctccagcagcaacgtcatcaacgctactcacattactgccactgctactcctacctctgacagtgataacgtcaccgtcaccagtaaatctaaagcggcatccgtggagaactggaaaaagcaaaggcaagagcagcaacgggagatcctcgccaagcaacaggagccgcttcgattcgcttccgcagcagccaaaaactcgtcagcttcagcttcatcacctcatatttcctccatcccaggaccaggcgccatgggcaacaacaagaaaaaaaaccgcagtaatgctggctcaggactgtcgcatgcagagttcccttctctctctcgccccgaaccagtggctcccgcgccgaaacaaccgaaacagcccaaaaaagcaaaggacgttgtgaaaaagccggatcctgtccctgagccaacctctgcctcggaaaactcggaagacgaggacgatgaggaagaggagaaggagcagcacgaggaagaagaacaggaggaagaacaggtctcgcgcgaagtcagagatgctgcagacgaggaccaagacgagaactggacgacagttaacacgcagtctcggtcgggcggcatcgacttcagcaagcccatggatccttgggttgcccagcagcagcgtgcgaagcaagagcgaattgcggcggcagatcctcatggtgaacagcaggcacagttcgctcgcgtgctttcgatcaagcctaccgttaaagaggatagaattcgggaagctgtccctgacggcttttcggtgcaaaagagtgagtgttagcgttggatgtcgaggccttgtttatgtggtacgtgctcgcgcatttgacattaacgtttgtgatgtttttatgactggatacatagcgcgtactggaggctcatcaggaggatcatcctaccagtctgcggaggtgaccaagaagcagcgtgagaatctggccaaagcagcgaagaagaaggaggacaaggctgcgatggatgcgatgcaggagaagagacgccaggaacacatgcgacaagtcaaggcagaaaagatgaaggaattttaccgctctcagtccaaaaagcaggcgccttacgtggagtcaagatgggacgttcccaagaacacggccccgtcgtcttctgccgtaagcggcggtatgtcatcccaggtgaacgaaaagggacaactcatctgggattaaagatgtagttttttttgaagacaggtcggctgcagacataagtttggcgcgagaaaataaaaaaaaaaatcagacatggttttcaaaatacagatctctttgtcgtccacccacactcttcacctccctaatcacttgcatccacccaacacgccttcacgcgcacaaactcattcacattcaaacacgcgcgcccacgcataagacaccagcatcgccgagcccggaacaccggcgaatgagcaaccaggactcggatgagacggaagactgcgacactgtacagctagtccgcgagccattccatgtacgtcaagaacgacgagtgattcgctgtggacacattcgctgcggattaggacaatggcgtgctagctgccatggtggctcggcactgccccagggagccatgagacgccgcgcttacagggtgcaacacaaactgacgcaggtccacttcttttccgccttcgcgtttgacaattgacttacactcctgcatgtagatgacctccatacaatcctttgaagggaggttgcttccaaggtacagctgaaactatcgaagctaggactgaagcagtgttgtagcccattgctaggaggagccaccaaaaggcattctcaggtgggaccacagggcagctggagtgacaggaaacacagcaatcaaagtattctgaggaaacaaagggagggatcaaagaaccacaggaggtgttggggggcaatggcaactggacagcacatgcttgcacgaacacagcagttgagagcttgccacacctgtggaatagcaatgcaaggacgacaaggactggtctcgaaacacgagactgattcactatccctcttccacctgcactactagccctacagcacccaagagacagggcgtacctattgttgttccacaaacggagcgacgaccttcgagctataagctagaaaccagtaatccggcactgctgacaggcttcagggctggtggcatcataaagagaaagcctagcatctcacagcagggccagagagccatatcgcctacattcaatggatcgagaggcgacaaacacaagatcaagaaagtagcggccctcaacggtgagcacgtttgccttcggaccgcgcgcacgtccacttttatgcaaggaaccgtcccctaatcttgtcttttccctcaacagacgatgactacgagcttgttggcatggctccaggatatgcgaaggcgctaaaggacaagcaaaagacggttggtgatcattttaacgtgggatttcaaggtcctgcgtttttcaacgactgttataaaagccgtaaactaaccaagtgtatcttccttcgacgaatctacagagagcactagagtacgttttgttgagcgacgaagacgagcacaaaggtacggactatcagatattcaggcaacttattctcttggtctcggacacccataattggtaccaggagtggctgatactctttaatccatctacaactcttgccgcatcggtagataccaaaactgtgaagcggaaaaagacagtcgagacaagtcctggttttggacccttatcgacaccggcgaccataggcgggcccttgctagctgcgatcaggaaatatgtatgtttgcccttcaggatgaactgctttgtgatcaacgatgctacgtgctcaacaacctaacttattgactcacttcgcgtacttgcttactgctgaatcccctagtctacaccaagcgggcctctatcaaaaccagcagcgatcgcgccagctcgcaccacgtcagcatatacatccactacaagctctggaagtgtcgcgtccacatctgataccgcgtcgagtgcctcagcttcagtattaacgacaccgccgtcatctcgggtcaagcacctgagtacagcacacagtccattatcagaaaaagccacagccctcggtatggggaccttcccacaagcatctctcagcgctgtgcggtgtgagcggattacagaattcacgaatacgggcatgacgatccaattcgggccggagcggctaatcattaatattgacaagaacgtaacaaagattgggcatgatgtcctaaaggtcgtcgaggtaagctttggaacagacaattcgtgaatgcagcatgtacaagactggcccttaacactgcacacatcaacctgcaggtctttttcgacggcgatccaaaggtgctggtgatctccttgtgcgaaaaactgcccgaaagttccatactttccgagttctatgatcctgcacctcattccgggaaagcgaggaagatcactttgctctgctcatgcgattcagcaatcatacagggctactgcaaaagactttcaaaaaaatcaattcaagtcaagccattatcgtaggtgcctttttcatgcgacatcatgcaaagactgtcactgccggatggaggaccttctaacacttcgcatcgctcctttatgctgaagaacggacgccgtagccaggattttgagcacaaccgttgtgagaaggttcgtctgtgatgaggagattcatatagtttatgtctagttcggatgaccgtttgcctaacacggtgatctgtttgccctcaaccctcttgccttcaaacttcttgcagcccaacagaaactagttcgtcaagtcaccacagtagtgctacagcaccgagcgtcaccgccaaacctttggccaagttagatcgtcacacctcacctcgccggacaagtcagcttcacgacacgtatgtgcataatgttcgatttagtccacagcagacctcatcacttgcaatctagttgctaatcatctccatccacttcactgctatagcttgtttttgtttccgttcaagaacagtgccaaatcgaagtcaatcgccgtccacgtggaagacatttcgcggttggatgaaggcgagtttctcaacgacaccctcatcgagttcggcctaaagtatgtaataagactattctccaaggaatcgcacctccgccacctttcattctcaaccctaacgctgcactttgatagatatatctacagcaatctggaggcactggacccggagctggcggatcaaacatacatattcaattcattcttctatcagcggttacttgcgaagccagggtaagctgcgctttccacgcaaactcaactcaagaactgaaaaggctgaggagtcatgtctttaacttgacctgcctatccgttatagcaagggcatgtcctcttcgtacgatgccatcaagagctggaccaacaagattgacatcttttccaagaagtttatcatcgtgcctattcacgaacagtaagactaacgctttcattgctgctctgaaggcgcttcgattgatttgtcgccactatatcggagaaagttaacctccatcctctttgctagcatgcactggtacctagcaatcataaccaatcctggtctactgctcaaaggcgcagacgtgactgaagcgcattcggatgcgagttctaaagctagctccagcagcgagctagaaaacacgtcaacggccgcctcgccagccgatagcgaccccgccagtcctagcgcgaccgatgaatcttcaaaaccaagcaatgtcgcgacaacagagaggaggattgaagggttattttcggccgtcgacaggttattaacatcaagaaagacatccattttgaacgatgaacggccggttgtaagaaggagttcacggtcgacttcgtcagcagttcctgtggacgcagaggaaaagccctacatcttggtcttggactcacttggaggcatccatcccacggttaccaaaacgttacgatcttatctgcagcaggagctgtcggccaggaagaatattgtgaaaagtatcgaccccaacactattcctggaaagcatgccaaggtacatttatgacaaggttatgtttgactgctctttctttttcactttcgaagcctcaactctaaccatggtccgaaaaccaatcttacataggcgcctcagcaaaaaaaccattgtgattgcggcctgtttttattgcattatgcggaggtattccttaaacatccaggacaactactggacgcgattgtggtaagaaaaacgatgccctatacatagattggcatgatggcgtgatagactactacaggcgactaatcgcatttgtgttatcctcgggcaactttgaatcgtggtgtagaacaacaaaagggacgaggccaacaagtactgggccgtggaggaattggcgcacaagcgcgaacagtatcgagagatcgtgctctcgctaacggaggagtacagtgcttttcagggacgaccctgaccgagctcaccactggcgactagagtcatgcctggatgaacctccacttttatacaacagttcgcagacttgcacaaacacatctatgctccagctctcaattttttttttcttcctacgttgctaaaatcaaaaggcatggctgtcatgctatgcctcctcgtcctctgcctcctaaggcgtcgatggcggagaacttgctgaagaggggaccttgcccctggactttcgtttgggcgccctttttggaagcgactgtgcgatgtaccattcagtacaaacatctttagtccccatcggagacgttttgctgctcagtaaccaagggcgctcttccatgtttgtgcgcatgaaagctgaatgtcttgccgtgcgagaaaaaatagtttgcccatacgctttcgattgggtttcctcacagagtatgacatcctgagaagccagggcttgatatccaactatcttttggagcccagtgccgaaatggccaatgcgcaaacaaagctgtcatccgccatttccaaaccacagtggtagtagtacctgttgcttcgaaattacatagctgcatacttcctctctttgatatgcactcctatgtttgattctcacggtaacagtgaaataaaccgacaatgagtcctcatcttaccatcaagactatcttttccttggaccatagagggttcttttacttcgcgcgaccactctcgctagaaaatcgatgtaggcgaatgacatttattacgcttccttgctcaaagggatgggtcctcgggcttctgtacagtcgctgaggatgcctctgatgctggtaaagaagcctcgtccgaaccttctaaagaaacaccaccgtcaccaccatcgcctccgcctggggccgagatcgccacctcaactgctccagcatccgccttatcctgatccggcgcatctactggcactgcactctccaaggccggggccgccggtgttgattccgctgacttctcctcagtcgattgagcactgtcaatggtcaactgcccgtccgccccatcgccatcgacatcgatatcgacatcctggccgccatcctctgcattctcgacgtgaacgagcccgccatagatgccatcatcaaagcacttgaggatgtagtcttgtactgcccgcttgtacaccaccacaaagccatccatggtcttttgctcgttcaaggctgccgacctctccataccctgtgtcctgaattcaatcttgtcactagattcatgagatgcctgtgctgaagcccccgcaggagacaaggaggatctaaaagcggaagcacgctccccaaaaataaatcgatcatactcctccagggctctgtcgaccctgctcaagctatccaccaggatctcgcgcagcggcagggcgagtgacagcggggccaaaagtcgcaaagagttgagtgccgtcaggtacgagttggtcaggtacgcgagggccggatagtccatcagacaggtctgaggtgacatggatgtcgagccagcacccccaggcgatgctgatccgagcgcaggcgaggactttgtggaggaaggcggggaagtaagagaggtcagtgggcgtcctgtacctccaagcatccattgtgatggcagcgcccactgcggatagtctctgccatcgccaccaagactgtccaggaactcatctgcgcctcgttgaaaggcacctcctacgactcggataacggcttcctcgaacagggacgtgacaaggtaccgaaggtcgaatccaattttggccatgttggcaccaaagtacatgagttgcgtcagaactgaagacagggccgaggtatcgtggatttgagggatgtgattcttgagtgtttggagcaagatctgcgttcggtaggagacaaagtcggcgagaaggttgtccgtgctccagtaatgttgcttctgatcaggaggggatcgtgatgaggatgatgtgaagatatcggctccagctcctgctgtttgcgctgctggcgctgctgctgttgttgatgtcgttgttgtagttgtagatcctctgtagtcgattgacgaaaaccccgagtagttgtctgtactgccaaaaatgctcttgtagtaagtcatgatgtcgaacaaacattcgcgtgtgacatcgacatacttcttgagatagccaaatgagtctcccttgtggtgcacaatcttggacagctgcatgttcatgtaaagtgcccgggatttcaagaagagcatcttgagaggtgtctcatcctccattgccatggctgagactgagggcgaggtggaggacgatgtcgaggttgggccagcatgtccacttcttgacgccctgctggtcgacagtccttgatgaagctgctcctcgtcctcgaccacgtccagttggtctttgaaacttccaatgcgcctcaagaatccaatgatcctgagtgcgactggcagcttgatgggttctcttagctgcgccaacaactggaccaacatcagctccttgccctgtgcaactttggcgtctatgtcctgaatgattccgatgccggggtaccgcagcaccagtctctggacatgactcgccagctcaagggcctcattatagtatccattcctgacacaggtttccatcaacaaggggatctccaggacctccagcagctgcgagtgggtggcgagaatcgaggaaaagatgtgctgccgctccaggatagacgtcactcgagccgagaacccagacagagactcgacaaactgagggatggtttcctggaaggtgtccaagtgctggcccagagcctcgaacgtcgactgcacctcctgcttgcagtccttgacgaggataaaggccttgtaatccctgaacgcgagctcagacatgtcccgctcgaccttgagttgttcctcgcgcagtttttcgggctcggtgtgaagggcgcgtgctggcaaggaggtgagtcgattgaggtagtccttggaccatgaggtcgcgagcatctcgcgtttcgagggcggcaccttctggaggatgagatcaaaaagagcatcctggtcggtgctgctgctgggagcagcaggactgccggcgctgttgtcgtggccgtgcgggtccagcccctgtgcgtgctgggcgctctcggtcgccatcatgaacgcgagagggtgagggtggaggcgagtgaatgcagaaggaggtgggtgaaggtagagggatgcaaaagaggatgaaccgcccaagggcgaccgcttttttttttttgtgtgaatttcgaaggcgccagaaacccttatgcagcccacagaaacatagagcacaaaatgtcggcggccacggggagataagtatattttacagcggtagaaagagaaggaggagtgggcggaggaggcttgtaggggggcacagtgtgggtatgataaaagtaaagaaaaaaccctagggtattaacaagtcgtgtgagggcatgcttcttaggaccgacgcgcggagaggtgggctgtctctgggtatgtctccagggctggctgtagctgatgggagctccggtccgagctgcccgacaatcggtccttgtggctctcgcccgctgaagcaacagaaaaactttcgtccttctttcgatatggatcaatggacactccaatgccatggccactatcaattccgccatgtccagacgacccatcatcaaaaggcgacctcctgctgctgtcgttcgcgggggtgggtgcatccctggtgtgagtgggctcctggatctgaccattggttgcatgctgctggcgatccaagtattcgctgtaccgccgacttcggggccggtcaaattccccgcgcctggccagctgccttgcatattgctgcctcagatcatcatcggtatatccttgatagttgacggtatcgactgaatagttctcatgcagcacgcgcatgggctcgtccacaatcaagcgagggttgttaacctcagaatgcgttcttccgtagatgagatagataaagattccaatggccatccagactaatagcctgataatggcttccttccttgcattttgaaggagtagtaatgaactccctgcgcctagcccaggcaataagaatggtcctacagagcgcaaccacaactggaagatttagaatgacgcccaaagcgcaattgctcaactctcgcattgacagaaacggcacactcctacctcctggtactttgaatcgccgaggcaccgtcttacgggtatatctgagaataatcacgccaatattaacaacaaaataggcgaaaatagtcccgacggatgagatgtcgctcaagatatcgatgggaagcagcccgccacaaagtgagcagataactcctgtgatcacgctgctcacgtaaggtgtctacatagttgcaacaggaagaggtgtggctctcggttagcactatgatgagggcattggctcaggcaacgtgataaggaagtaaagtaccttatacttgggatgaatcttgccaaagaaactggggatcagaccatcatttgccatcgcgtaaaagacacggggctgtgcaatgagcaggacgaggctcacggacgtggttgcagctatagcacctagttctgtcaagaccaccagccagtgcattcccgtcagacgaacagcatccaccatgggtgaggcacctccaagagtcgagtagtgcgcgactccaacagcaacaacgctatgcataccgaaattgcagaaagaagagattagacttctgattggccaagctggctatgcacactccccttcaactatggatcgaaaaccatgtgcatacctgattccgacatagataagggtggcgatgacgatggttgccatgatcccgacaggaaggttgacctgcggctccttggcctcctgtgcggtcgtgctgatgctgtcgaatccaatgtaggcaaaaaagaccgttgatgcaccagcaagcatgcctccaactcctcccgtctcctgtggtatgtatggttggtagttttcatgcttaataaacggaatcatagcaaagatgatgattatgagcacggtgaccttgaaagcgacaaggcagttgttgatcctggctgtcatgtggatgccaaagtagatggtggatgagaccatgacagtcagcaaacaggcgggcacgttgaaatactggcctgacatgataaaggtgccgttcctatattcgatcggcgcgtgcgaccattgtagtgggatctccacattgaacgcgtccttgagaaatgctctcatgtaggaggaccagcccacagacacagtggctgctccaataaggtactccaagatgagatcccagccaatgatccatgcagccaactctcctatcgatgcgtaagcgtaggtgtaggctgatccagctattggaatcatggaggccatctcggcataagacaaggcagcaataccagagacgaatcctcctaggaggaaggacaccgtaacagaagggccagcttgagtagcagcggcagaacctacaagcaacaaggacacttgtataagctttaaatacacttgctacctagtgcaggtgctgaaggctaaaacaaacttacccatgaggacgaatacaccggtgccgatgactcctcctaagagacagcaatgcaaacaaaaggcgttagagggcactgcgtcgtgtgcagatattgttgcatgcgtgcatgcgtgcgtataggtgtgcgtataggtgtgcgcatatgtgtgtggaagtgtgtagggatggaatagttgctcttgtgtagatgatgtgcatgcgtagtctatgtgtctgcgtgagtgtgcgcccgtcagccagtcattctgtgcatttgtcagttgtaaccacagacagagccctgctgcacatcgggaacagaaaaccttctttgcaataagggccctcacatgttcacggtggtgctgcaaagcatgtcgaaatcctctcctctctaccccgcgaagtacaagaaaaagacactaaaggctgaacgcgcctgtgttcagctcgtctgcccccaccatctttgcaacgagaagtgtccacacctttcctgcaacggtcatcaacgactacaacaacaacaacacaacaacaagaagaagaaggacagtagggcggagtgtgtgcggatgcaagtctaaagcaacaagagtatttcgccatccgtccttaaatgcagctcatagtgcgaaaaaccttcactctaatgcgcgccgaggcatgcgaacaacacatgaatatctcgagtgagcagaacacatagcgactggaataagctgaaaggtgagttagagcacgatatgtacaaaacagaccccacacaccacacagtcagaacagaggcccaggttgcaagcgagcgggcataaacaaaggtcaaagacagcaaccatgaatatgaaaatgaaaatggcccgagggaaccccgctttcaaggctgtccttccagtgtgggcgcaggatgacaagagtgtttaggtgcgtgcattggctgatgtatatgttgacacgtatgctgtgtgagtgaatgaaagggggtgtgcgtccactgaggcagatgtacagatagagtagtacatgatgcccctcctttaggccaacgctgctctttgcagcatcatctgcatgaaaagaaagatctggcagtttgataggtgcaaaaagacgaacccacagaaaatggaatgaaacgaacaaagaaaaagaaaaggagctattgcgagatggggatcaagtgagaggaaccgcagttgttgcgtgagaatcgcgacgatgcacaccactcgggatatgccagtgtgggtgccaatgtgtgccacaaggaagggaactgggaggatgcggcaccggacagggcaccggacagggcaacgaggctgtgttgggtgcaaggaaggacacttgtcgagaagcctaggccctgagcctactgggctatttcgaaggcctccttggattttgtgtcaaagtgagtgtgggagtgcgcgtgtgtgggatttttttttttttttgccctctgtaatcgtccgctggccagtcagcacaagcgaaaagaagggaaacacctccagagagggatagacagctccctcatcagtggtgtggaggttatcgagaaagtgaagggcaggggacacagagtaccaaggatcgtcgtcgcggtgcatgtgccttgtgcatgcaaacagcccatgctgccatacccaagagcatgccctacaccaagcagcttttggaggaaaggagtctgcagtctcacaaggtccacgccctgtacattgtcatcgtgctggtcctggcctgcattggaggtagaggcatcagcccgttaacggctcgtctccatactctccacttctccttttcactatccactacatgatctgaggaaactggtgaatcgtggcaaccgagagcagggcgcggtcgagacgtgtgacggatgatggaacacaatgcaataagagagagagagagcgagagcgagagaaaaagagagagagagagagagagaaacaagaacctcggtccccctcgcttccgtgctctgttggttgggggggatggacaggtgctttcctttagagtgatagcgagggaaacattaaaaaaaaaaaaagcgtagactgcataggaaaacggccatccggcgaaacgctcgcagcacacagcgcagggacatggcatgagcgcgaaaggtagaattggcggcagcagctgaaacaggccggtagacggagggggggatgcatcctcacaacggtcaaaagggcctagcttaccaagtccgacaaaggtcagttctacggggcccagtgcccggttgaacttggtctctgcctcctcgaccgagtactcgagtcggccgagggtctggatcgagatcagtcgccgggcatggaagtgcagcttggactcattgggctttcgaaatggcgtctggcctgtgtagtagtagccttcgtcatggtcgtccatctgctctttgtaaaaagagagggagtgcttgtgcgaggggatgtaggatgtaatggtgccagagtggtgaggggggaaaatggaggaaggggcgattcaagagctgcagaggcaaaaagagcagtgatcagccttgtggccaggaggagacaaataaacagggagcggggagggatgtgtttacagcgtcggagacatgaggtgaagtggtgaagggagcgagtgacgaaggagcgatgatgaacgggatcgggcggaatcagctgttccaggccttgtgtgttcagagacgcggaggcacagaagacacgcctgttggtgtgtatgtgtgtgtgttgtgtgtgtgcgtgcgtgtatggggtggaaagagtaggaggagagagagggtgcgagagagcgagagacagagtgagagagcgagagagagcgataacagggcgagaacgagataagagagagagagagagtggtgtgtctgtgtgtatggataagaaagcgaaggtactacgagtaagagagatggaaacagcgccgaaaaggaaccgcaggatgaggaaaaccgaatgacaggccgatgcagcgacaacggctttgcattcgcgtttggctgttcgagcttgttcgcttgtccccactgttggaacaaattttcattcgttgcatcgagcagcgtcgtcgacatgttacaaggcgcttgccaacggtgtaggattgcgacccgcgagggcgaaactcgttcacgcacaacatgcactaccgcatgcacacacccccggccagagcatccgtagccggctgcgtctctcgggccttgcagcccttgccggattgcatatccgtcctggacagtggcatgtggccgtctggtatggtggtgtgagcccgcccacactgtcttctcgcaaagctagaccctctggactatgcacctcgggaagcggtccttgtctttccgtgtggtcctagagggcgttgaagttgacactgagacagccgcactctggccatggctgcagccatggctatggctacgagcaactttagtgtgcccgaaggttagctgccttgaccgttgatgcttcgaatcattatgaaatgctcttcctttggctcgagtaacaaagttatgtcccctcctcgccctctcggttcgcattttgttgaacttcgtgtatgcctgagatccatagtttaatacacccttgtgtttcaagagctgtttgtcctcgcttcggattacctggaaaacgcgttcttatctgtaagcaaagtgctcatgtgtacgttaaaaaatgcatgtgtatctgctccaggctcgatcgctcttaacgatcggataccataccagctgccgcctcgccatgcgaacttggcggcaaaaaaaacctgatcacgtgcgcttgagttacatgtcagggcatcgcacatttcacttgatccgcttctttcaaacacacaatgtctacagccccggttcgacgctcaggattgcaacgagacattcttgatctctaccgcaagtgtttccgtgctgcaaggctgaaacccgaggtacattcaagtccttgttctgcattagcttcactgtctctagaggctgacttttccgttattgactccgttttgcttcacttaggcgaatcgtcctcacttccacgcctttatcaggatgcagttccgaaagcactcggaggtcaaacagcgtgattttgcgacgattgaatacctactccggacagggaaaagacagctggaggtttattctgcacctagcatcgaggatgtcaccatctagaagcgagacgcgagctgaacgctcgacactctgaacgagcagcgcaggaagcccatccaaacgagccaaagcagtgtgagagagcacaggattcggggaccttgctcgcctgctttcgatttgacctggagcgcgggtcacgaccagggttgcagaagagacaataacctcgggagacatgcctccaccttctgcaggaagcgcccacccatagacgatatcggctcctgccccttaaatccacaatgtacatgaaggctgaccgctcatttcaataacctctgatcatgaacagtctgcagaatacccatggctatcaaacgcaatcgcaacggtctcgattccgctcctaatacatcctcaacccctcgaccagctcattccttaaaacgtcgaaaggccgatttctcaccagccagctcgccttcaacagggcactctgaatctgaatcctccgtaaccgcagaatcagaatcagagactgacgaccaacggactggtagcgactcaagcgaggccagcataagcgatggcagcatcagcgatggaagcataggcgatggtaattcaagcgacagcgacgagcatggttcgatagacaacaatattgtcactgagaggatagggtctcgaaactccctagcgaactctgcacagatggcaaggcatgaacgggactttagggattggaagtggcaaatgcgactccactaccacggatatcaagaggcggaggtgagcgaaagggaggatccgagaaagggtctgtcccacagatcaatgactcctgcacatttcagtcatggcccggacgtggaactctggtgcgagaggattgtcgaggacaaaggagaggaagaactagagtcagaccaggcaccgcctctgtcgccagaagaacggaagaggtggctcgaaacgcgagcgcgacccttagtcggcgcaggcatgtgttggacagccgaggaaggcaatcgctttttccatggactgcgccggttcgggaaacacaatgtctgggctattcaagcgcacatcaggagccgctcgctggcagaagtcgtagcaatgatccaggtcatggagatggaggtggcacggaggcattactttcgactaggttgtctcgacgttagcagcatgcctatggctgatgaggtggaccagtctgtgttgaagttcgaggaggcatgcgctagtaaattgctatttcgtgctcatgagaagaaggcaggagcagatgtgacccccgctactgccgagaccgccacaagggcgaaagaacttctcaacgaccgtgcgatcatccacttgcagcatctacttcggggacccaaccaacaccggacaatatccgaggttcaggtcgagctgctcaacgcccttaagagctggctgacggctgtgatcgaggagatggccaccctgcaacacgagcgacatcgagtttccaacatgctctgcaaggtaagaatactttatggatgttacaggccattcgtttgcactccacactgctcacaggaaactccatctttgggctgtaggagaaaccttccaagaacattccaagagtaacagagttggatgtaatacgcactctacgcgccaggatgctacccttggacgttgagccaattttcgaacgactggcgacaacgtatccgggaagcactcgaccatcaagatccgacagacggagggaacgaaagcacagggcaaagtatcaaaggctaaacggatatgacgatctctttgaggaaaaggcggtggctgtccccaatgcgcgttttatcgagcaatatgagccagggtatggcattttgccaaaggatgcctcattcatgtacgacatcacccggccccctcccaaggcggggttcggcctaggccagcgtgagcatggtggcctctttttcatggacaggcagccgcacgagcagtacagctcgagtggctacatcactgtgtccgataccgaggacgaggaggaagaggagcgaggctggacgcggcaaatgcaagcggacgagattcttgaacaagcgcacacgatactcagcaaatcgaggacttgacagattttcgatattccttccacgtcactttctttgcataaaggtgtgcccaatcttgctctacatttcctccactcctctgctcctccaccacacacacatcatgcttgctctccgctcccttcgcgctcctttgaaccgcgccatcatccgcgccacccctgtcgcccgcttctctgccctctcggtccgcttcggtgagtgttggcatcacccctgctcctcggtgctttttgtccgtgttctttccggatcaaaggacgctgtgccacctcccacctccaggttcgcccaagtgcggcaatctcggagcagccagcatcacccaacctttccctttgcacactcacagcgcgcgttagtaccagcctcaaaaacaactacacaacagaagcacaactcagcctgcgcgacgggagacaactgttcatttttttgctttgaatggtaacccatcagaggctggattcgggatcgaacaccgaacagcaaaccataggatgtcgactgcacaaacaggtcgcctttgtgctcggattccccttgtcgtccttgaaggggatggagatggagtgcgggttacttgagccctgtcaacttttcaagaccttggccatgatccaaccatgggggcatttcggagacgtgctccgacaagcttgcccagtgttcggaatcagagccttttgcctgctgttgctcctttgctttctcttgttctctctgtctctcttccttgcgcttccccgccgggagtagtgtgtatggtcagtggaacgcgcttttctgacccgtaccgctttgcctgtgtgcttgcttctcgaataggcggtcaccacgaggtcaaggtgaagcagggaccgggtgctgctcctggtgccatccccactgatttggaccagtcgactggtctggagcgtgccgagattttgggcaagatgcagggcaaggatatctttgaccttgctcccctggaggttctcgtccgcggcaccaagaccaaccccaccatcatccgctcgcgcgaccccgtccgttatgtcggatgcactggtatgccactgctgcttttttatcgtgtcaggccatggatggccgcagactgaaatctctcgttcctctggcaccgctgttcctgcctgtgtctcctaatatgctcaattgctgtattgccattccgatgggcaactgcctgtctaaaataggtgtacccggtgagacccatgagaccaactggttggtcattgaccagtaagttgacctgttcgcgcccgttcaacgaaccttgctgctctgacgatcgcgcttgcatgcgctgcaacaacaacatccgttgctcaccgctgctccgctgtcctgctttttccttctgctaggacacacgactttgaccgttgcgaccagtgcggcaacgtctacaagtggtctgcctacgagcccgacgagaactttcccggtgctgagaagggtcaccaccactagagagataacgtacgagagccgtagaagagaagaaacgcagttttttgttacagtcgaagagtcctcattgtgcccgtgctgtcacttatggaagctggcccttggcctcgcgatagcgtttgtgttcgtgtgaagcgcaaacccatcccagcaccccccgcccgttgctatccgtttcgacgtgtgggatatgttcaggacagactatcgttagccgtttgagtcgagtgcccatcgagagatggcagggatcaggttgacaaacgtgaatgctgtatctatgttgagacgacgtgcaggcgaatcctctgcggcaaggacgcgttttgttcactcgcgccctgtggatcgcaagacctctccagacacacacacacggtccagtgatgcagtctcgtttcgttctcacgccgttggcccccttgtgtagccatgcgcctccgcgaaatcatttctttagactctcatttcctcgtcgtctctcttttcccttccatcccctgcccacactccattccatccagctccacgccattggcatcgtgattcagacggccagaccaccatgcttcatctctcgcgtcatgcactgctcagggcctcgtccttgaatccatgcacgtcggcttcgcggagcctcgtctcatgcaggccccgtcgcctgtcgaccctgaccacgctccgcctctcggacgaggtgcgatcagcgctggacgccaagaggcctctcgtcgccttggaaagcaccatcatctcccatggcatgccgtatcctcaaaactacgagacagctatcgaggtggaaaagatcatccgcgacaacggggcgacgccggccacgatcgccatcatggatggtcagatcaacatcggcctgtcggatgagcagataaaccagctggccaaactcgggagggaggccgtcaagacctcaagacgcgatctggccgtcgtgatggccaaggtaaaaaatcgcaacgtcaaaaggaggcctcaaacgaagaagatggacgccccaagaatttggctcgctaatcggcttttttttttttttttttgctgtgatgatagaaacaaaccggggcaacgaccgtgtctgccacgatgctgcttgctcatcgcgcggggatctcgatctttgcgaccggaggcatcggaggcgtgcatcgaggatacgaaagcagtaacgtcggctctctctttctcactctgccctgcctctccctcgctcttgcatggtccatgtaagcaaaaagccttcgtgtctcatcagagtaccacttgccatgaaaatcctatatatcgcatagcgctggatgcaagcgccgatcttacggaactcggtcgcacccctgtcgcagtggtctgtgcaggtgtcaagtcgatcctggacattggcaagacgcttgaatttttggagactgagggcgtcacggtggccacctatggccgcacgacggactttcctgcattctttacgcgaaccagcggattccatgtatggatgctgttgtgaaagataactttatgggtcgcgcctttgacgccacgggccactgaccagctgctatacctgtttctttctgagcatagagcatggtgaatgtggaatcaccaagcgaggcagcagcaatgatcggtatgtgacaatgtaacaatgagttcaagcgcaaagctggaagctccttataccccatctctgacgcgtgattttcgtctaatgacctcaacatgtagctgcgaaccacgcggtcaaccttcagagcggaatcgtcttcggtgtacctattgcagaggcggatgccatggacgagagattggtgggagaagccattgatctcgccgtcaaggaatccttgtaagtgcgggctctcggcaactcttcagtcgtggaatgggcgatcataaacgcgtcccttacttgatgttcctgaaacctctctctctctctctgcacagcgagcaaaacattgcaggaaaggagagcactccgtttttgctcaagcgcgtcaacgagttgacaggaggcaactctttgaaatccagtaagtagtaaataccttgtacgaagatcatttcatcacgccgatatcttttctcactgaccatgactcttctatcgggcaatagatatcgcgttggtcaaacaaaacgcgggagttgcggctaggatcgccaagagtttatcagaactggtgcgcaacctcacagtcccacagaagttgctcgattgctcattgttggaagctgaccaatctatacacacattctaggccccacgtcgtagttactccagctcagcacgccagctgaacaaacatgcagtcaatcaaggacctgtaagttaaaccactgacttctcgggatctctgttgtggttgggtgcgcgcaaagagtcgttagggcaagcgagagcgggaggcagtggccgtcctcaaggaagaaggcccatatgttaaaggatccaagccgcgaataaaagttgatgcgatttagcgatacttgggctttctcaagagaaaaaaaaacaaagtagcatcgatcatgaggatttgccgattctgaaagcgagatcggggcgagctgattcgttttcatgtatgagattgaccatttgtcaattattttcttttcttccaccctacgaaccatctctctctagatcatggttattggagggatcgttgtggacatcacctcaactgctcacactgcatcagcggattcgatgcttcatagctcgtaccctggcgcgacaaggattgcagcgggtggagttggacggaatgtcgccgaggccgtgacgatgctgtgtccgggtggctgcgtcttcgtgtccgcggtcggaggaggccaaggcgagggctcctccaccgaggacgtgttgggatcatggcttatcggccatataactcgcaaaggcatggtaagggtcctaagcgggccgttttatgactaccgtttccttttttttttgttcttttggcgaaaacgaggtcgtaccaccaacacgcactccttgacgtatcctcaggcgaatcgagcgatcttcccagtcccaggctttaggacagcatcctatacagcactgcatgacgcgtcggggggcttactatccgccgttgcggacatggacgtgtttgagcgcctgccaattgacgaggtaacggaaatcatgtgccttttgacgcaggcaaaagaccctcacacatcatgttgtacgcaaaaagagttctcactcctttctggttttcctttcattagatgagggaaaccattgccagatatcgtccccgtaccatctgcttcgatgccaatttgtcagtcgcgtgcatgcagagtattctcgagacctgtcgcgaacgcaatgttatcagtacgtactagagaggattaccgtgggggggtctgtctacaaatgtattatgttttagtcgtgttgctgatctcagagattatctattttttatccattgtcgggggcgagcagcactttttgagccgacatccgaggccaagtgcgcccgcgctctcgatgggtcaatgctccctcttttgaacgagggtctcgtgaagtacgccagtcccaacgaatacgagctccggactatggcggcccaggcaagaacactggctacagttcagagcaaaggagcactgtcagttcaaaggcatgccctgactgctgctgctgctgctgcagacacggatgccatcacgatggccgtgaaagacgccacactgaattatgaggaattgctatccgatgctgcggtgatcacgcagtatattccgacattgttcatcaaactaggagcaaagggtgtgctggtgtgtcagagaacgcgtccggacgatgccggccgcctccgcgatcaagacacgttgacctggcgttggttccaggcgcacaaggtcaacgaggtcaagagcgtcaccggagctggcgacaggtaacgggtcaagctgcggacaacgacttgtgatgttgcgatgaggcttccaacgacacgcgtgtactttttttttgatctcatttctaatattcataacctccccccatcactgaatgttttatagcttcgtggcatcgattatcgcaagcttgcataccatgcctgcgtccacgtcagaccctccctcgtcctcagcgacagggcctcagttctggaagcacatggatcgatggatctcggatgctcagacggccgctgcgctcacgctcgaaacctacgaaaccgtcagccctgcgttggcccagacccagcaggcaaaagacaatacgacttcatagccatgatacgcttccttcaagattcattcaacaaaaaaaaaaaaacaccctcgccgttttttccaccatgtttcattgtcttactctcctcccgtctccatcgtgcgtatattttggaagtaaatactcaaacaaaaaaccagaacctcctaatctgcaggcatctccttacgatagtcccacgcgtactgagaaaggtctccatggaccggaaacttcttggtgggagccggtacgctgttggctgatctcgatccacggggcgtctttttggacctgaaaccactcgactctttagaaggacccatgcccttccccctggatccttgtcgttgttgttgttgttgttcttgttgctcctcatgctgttgctgtagatgctgcggatgaagatggtgctgagttccgatcaaaatcctgttgataaacgacgacgaagacgacgacgacatggaagacccctcgcggaaatgacctttactgcgcttgctgtggtggtggctgctgctgctgcccttggtctcggacgaggatgagaacgatttcgataaaagactcatcttgtagtgcctcttttcctcgttcgacaacgaggtcatggtcgagatcgtggacgcgttcgaatcggacgagatgctcgaactcgttcgggtcgtcataaccgaatgggtcgtattggccgatgacatggacgccgaccgtagcctcgagaagggtgtcaccagcggagacgtggctgtgaacatggtctcggccgtggacaggtcgtggccgggcgagttgaacgtctccagctttgtggacgacggagagtggccagtcaggggctcgttgctgtaaggtggccaaggcgggatcaagtcgccatattctgcaaggagcagttcttgcgcagagaccatctgctgttgctgttgctgcggttgagcatgcctcgtcagagcggtcgacgtgtcgctaaagctgccaatggggctttggaccatgacgggcgaacgcggtgatgacgatgtcgatgagcccgaggatgtggaggacgagaaggaggaagcctctgacaaagcaacaggcgtggacacgatcgagctcaggacagacttcagccccaaagacgagcgctttcggaggctggctaggttcggtgacgagaacgacatgcggaagccttcggcgtccattccagcgccacccgccgccgccgcgccagctggtgagccaggtgtaaagaccgaggccgccttggcaaatgaggactcttcgttgttcaacggatccatactagcagtgctaccagccgcaggactctgcatcacttctgccacataggaccgccggcggagcgctcttaggtgctcgtccatgctctgctcagcagcaaatgcctcggcctggctttgttgatagaatggaagccccatccctccagctgctgcggcggcggcggcggcggtggcggatggcaagcctgggccgaggaagcttgacatggaccggtgactcctcaaactgcaaggcgtttcagcaatagtgaaatccactcctggcattgacatgaccattggcgacgcctggaccgagggtgccctgctgccgtaggcgcccacactaccgggtgcagtcatgtgtccgaccgaagtcgagcgcgggagcgtgttcaaggctttcatggtctccttgcccatgtatcccatgcctcctcgcgagataacaggcgtggtcggggtcattggctgatgaatgctaggcgagtaaggtgttgcgctgttgatcttcatcaggaacatcatggacggggagggagaataggggaagctcgacacttcgcgcaatgagctgcctgatgactgcaggattggagtgcctcggttgctgtaagcctcgtggatgacggccgaggtactccgagcaggccggaagatcttggcatggtcccgcatgcgctctgaacgcgatctctcaacagccgcaacgctcatttcgccttggtcgttggttagaccgatactgggtgtggtgttggcagcgttgctgctgatcgtggacgagcgcccagccacgactccaaagtcgctgttgctcctgtttcgtgtgttggctgcatgtgcggcggttaccatgtcgtctctattactgggagtgatggtggtggtggtggcgtgacctgaatgggcgcgctcgataaaaggtctttccttatgttgctgagtcgaagcattcacttggtcggctctgatacgcgtgctgtcgcccctcggattgacactgccctgccgaactttagagtgatggctgtttctacccatcctgtcgctgttggcctcgatccctgcgatggtgctcgtgtcgtcgtggctttctttctctgggctagaacacaaatagtcgctgccctccaggaacatattgttacaaatatcaatccccaatccaagtgaactactgccgctgacattgcttatcgaaccattggaatcagcacctcgctcgccaagttcagggactgtaagtgtgaggtcctgcttcttctgtggtcgctgactgctgctggcgtagtggctgccttgcttcttttcctgctcaggctgttcttggacacgctggttaatctctatgggcgatgctgtgattggagcgtctggcatcaagattgtgatatcgtctcgttgtcctctttgtctactccacgcgctgggtgtttcttctcgtctgagcactatcgccagaaatcccctgtacagctgcgtcttgtaggcccaccatccacaccaacccatccaaaagaccgacaccaaatacgtcgtgaccacagctgccttggtcgtgcggcaaaagtgctggtacatggctggtactgcatcgcaatttgagccattccgaattttataccactgcagcgaggctgcaaacaacgatgaccccatcaacccgaccgaaatccagagccgagggcgtggatagatcacgaaaagggatccatgaatcagtcctctggatattctagcccttctgcaggaacccatctgctttgtcgcactctcatcgatggcgtggacctcctgcagatatgaaccgatccgagtcatagcgccagctgtcctcatccaccctgccaggatcatgtacgtcaccgctaccatcagtgaagcgccggttacaagaaggagaaagagagctgtgagggaggtgtaaccgtgctgctgttggaaattcatggtcgagatgatggtcgagaccgcgtaaagacttaggaaggccaatgcgccgtgcacggccatgtcctgtacgcgatgcacacttaaaagagtatgaatcgactctataacatgttgaggatccgtgcgttcgtgtgtacgattttgatccgggtcacatcctggctgcacttcgaggcgagatcggtgctcccgctgctgctgctgttgctgatgtgatagatgtggatcatgaacaggtattgaagctcgcgcgggagaactatctaagtatgaaggcgactgtgccaggcgagaggcggacatttgctgcagggaagattatgggggtatgttgatatgggtatgtggctaatttgttggaccgtggaaaggagctgctttagtatagtttgcagacgatgttgctcaacccaatggaggtcaatgagagtgctgggcgtaccaggaaatgtcagagacgggtccaaggctcccggagtgtaaaagatgcgatcgcaaggtgtactcgaggtagtgtgatagcaattaagtgtgttggagggcgtgagggcatcaaagagtggaagagaagaaccagatcgggagggtgtgcagcctgacgaacaaagggcagcagacaataagagaaggggaaaaaaagcaagagcaacgcgaatacgcgagcgcccgcaaggagttgttgttgaaggcgggagagtacagtgctcagatttgcgtcgtcgccgatggaggagacggttgtccatccgttgggtaacagagagcgcccaaaatgcccactttcagaggcaagcagaaatttgcgtggtccagatgggaatcagatacgaatttgcatttcgcccagacactccttttgcctgtgatctcccaagcaggtgtgcaacattctttttccttctgtcggtatacggcatccctgtcttgcgtttgtatactcagttgctgcacacatcgacattggaataacggcgttttttttcgtggtcttcgcagtttataacgacacggcagatacaattatgagggaaaaaggatgatgcactgagaactctccgcactccttgttccggttactgagggggtctgggctgaaatcctgggtgtggggggcggaagccggggggtgggccttggaatctaccataacaccgttgcgaaaaaaaaaacattagatgtgaagacgtaaaacaaatctttgagcggcggttatcacgttgcaaagacgcaccctggtggaggggcaccggggacaaagccaggagggaagccaggggctcctggaggcatgcctggacgtgggtggaatcccgggggcatgggtcctccaggaggaccgccaggacggaagccagggggtggtaccatgcctgggggcatgcctgggggtgggcccataccgcccatgggacggaatcctgggggaggtgccatgcctgggggaggaagtccgccatgtgggggcatgccacggccgtacgacacaggggccgcagaggcggcaggtccacgaggaagcatcattccgggcgcaggtccgcccactccacgaacgggtccagtcaatccaggcgcagcaccgggcacgacaggcatgccgcggccggcaggagctgccactcctgatcctgcagtcatctgtagtttgacatccggagacgactgttaggtcaagcctcacagatcaggtgcaatatcaagcaaggaaaaaaatcaaaatgcggcctctacctgtgacaagcgcgacttttgatcctcggcgctgggtggcggtggtccgtcaacacttaagctgacgatggtctcgccgcggagaatgacaagtcccaatgttctcttttcctcgcgctcaggttgtccggcggcctttgccttcactttcctgaactcctcgcagtctgccagaacgaggttcatgtgcttgtcaaaggccagcatctggcctgtcaacacacgggagtctgacaatgtgatcctgagcctgaagttgatcaggttcatcattttcgagttttttgagatcgcctagagtgcaataaacgagctttggtcagaaaacaggaagataacatggttatcatggcacagaccaatccctggtgtcggcaccgtgcgtcatgctactggtgttgatgtgtagtggtgttgagtaccgccgctgacagaacggcagtgtaaaatgtattggtactgctggcgacttggtgcgttttgcgagcctaattcgacgggaatcctgccctgttcgtggccgccgccaagctccatcaggatgttccatgaacacagccgacagcgactctgtgaggtctcggcatagccaatcctgcctgctcctgctcctgctcctgctcctgctcctgctgctgctcctgctcctgctgctgctgctgctgctgcagtcgatcggtctgacgctccatttaccatgttgacgcgtgtggctggctaagggtagatggggatcagcagcggtcagaggtgggtgaagagaaaagaagggacacgaggggcgggcagagcagcagagagggtggaggagagcaagcgatggggagcacgattgttcttcctgtcgacaggcagagcggaacagaggagagaaacagagggaacagagaaacaaaaaaaaaaaaaaaaaagaaaagcgatggtggcaagctcacccactgccactcaaacacactgtcgtcgtgtgcaaaatggattgtgttgtcggtggcttgtcgatctctgtgctcggtgccgtaaacacctctgagagtctgcatcgctcccactcacccacctcgacctccacctcctttcaccttcccgttcattcacttcagtccgcactctccacacccactaccatcatggcccaggcattcaacaaactcggaggcatcttccccaagggcagtggaaagggtctggctggcggagccggtgctctgatcaccctcggcgccctcggctactgcgtcaacaccgctctcttcaacggtagcgtttgaatggccgctgctcagctcaaacagaggggactcggcatgcagcagaaccacacacacacaaaaaagacatgtctccacttgctgacctgcgacagtcttcgctccatttacacgcctatagttgacggaggtcaccgtgctgtcaagtactctcgtgtctttggtgtgcagaaggaggtgtttgcagaaggaacccactttgtcattccctggttcgagacccctattatctacgatgtccgcgccaagcctaggaacgttgcctctttgactggaaccaagggtaagttgacaccgccagaaggatcgggctcgctgtctgcggaaagtgtcagggcgagttgcgcatattgcgggcaagcacatcttgcggaaccgcaacgggaaccacgcacgccaccattttttatggaagacaggtggcagtaaacaatgcaacttgaccagtgctgacccgcctattatccatttacttacgcgcacaacacatagatcttcagatggtcaacatcaccgttcgtgttctgtcccgcccccgtgtcaatgacttggctgagatctaccgcactcttgggcaggattatgatgagcgtgtcttgccttccatcatcaatgaagtctccaagtcagtagtcgctcagttcaacgcctcgcagctcatcacccagcgtgaccgcgtctcgcgtctcgtccgtgaaaatctgatcaagcgtgctgcccgcttcaacatcgtcctcgatgatgtctctatcgttcacatggccttctcgcccgagttcactcaggccgtcgaggccaagcagatcgctcaacaggaggctcagcgcgccgcttttgttgtcgaccgcgccattcaggagaagcagtccattatcgtcaaggctgagggagaggctcgctctgctgaactcattggagatggtaagcaagataaggagcggaagggggtgtgcaagtgcttgggaagatactgttccctgcatctattgccataagtagtacttcctaatggaatgatttttttttgttacaatcacagctatcaagaaccagcctggattcattcagcttagaaagatcgaggtcgctagagagatcgccgccatcatttcccactcctctaaccgcgtcatgttggatgccgacactttgctgttgaacgtgaccgagcgcaagtaagtcataaggagctgcagtggcgctggttgctggttgctgcccagatgttctcaaattcgttcagttttaacacaaatccggcctctactttgaccttgttaggaaggatgacaactacgagtaagaggcgtcagaagtatcgtggcgaaaaaaccgttgtattgcataggaaggagtggagcagctctagacattataaacccaccttgtacatttcatgcggttggctcttcgtcgctcatagcgtctcatagcgttacaactcaaggttgcgtgtgtgccccccgtcttcatcggtgaagagcagttctgttctcaaattgggcatactttggtgttgtggaaccccagcttttcttacccgtctccctctttggagagcgcctggtaatgtctagattgcaggtgacaagttgacaaagctttgatcaccaataccctgggttatgtgagcaagagtagtcgccgctgctgcagcgcatactgggatcccactattagctgacggactgggatcggcagcaggaatgttttcgctgacaagtccagtctagaacccggctgcaaaaacgctcgatgtacccttttggttacggccgaccagcgcgtcttagacctgctcggcctgtctgtctgaactacagacaaggggagctagggagagcggaaccactcccacttgtgatggccaaagaagttgagtctttcaaatttacattgcagccgatgtttgggcaatctttggctttagacacctgccacatccccatacgctccgcatcctctgtcgaaattctgtttccggcgttgtgacctctccgcgttttactctgcgctcctttttgtaccaaaaggactctccccccgcgatagacgtcctatagggcaagggacatgcaaaaagcccacacgacggaaccaagggacaagaaataggagcaaagagactgggcatttgctgagctgtctggtcagtgcgctggcttgtcgatctcgctgcctcctaaagaggctgcattgcttcttaaaaagtccccctccacccatattctgtatcctctcccaccgctttctcctctcagaaagattttcaccctctacactcctccttccctctcgtcgcctcctttcttctctctctagcctaccttcaccttcaccttcagtttcgctggttattcgcccttcaccatggcgacccaaccctccgctaacccggagtcgtcttccagcaacgctgtcgtgcgtgcgatccatcgccactacagtgacacgacctacgagcgctcagcgcaaaccatcgagcgcgagaaatacctggtgtccaacattcctttcaatcgctgggccatgttcccaaccgcctttatgtaatggtgcctgctgatccctgcctttgtacctgcatcccgccccgtgctcacacaaacgcgactatgcgcgaacatcaaagtgctttccagcagcggcttcccttcattaacatataggtccctcatccattgtgtgtgttatctagcttccaagctatctgtggatctctttatgcgtgtaagtgcccttgcagcgtaaaagtcgtcgagatgcttctgtgcattaagctaaacaaaattgatacacaatgcagtcccttggaatgtgtgtgtgtggttgtacccgcctgatttgaacctcttcacgcttgcacttcttagggtctgtcttcaacgaccccatcgacggattcatctatggccgagtcctcaatcctgtcacaggaaagtctgctcctccagtccacaacgctgccatcacgttttacattgctgttggtgagtcgatatgctgaaacaacgcctccaaaatcatttttttatatgtggtctttcacctggtgaaaatcacagctcactgacagggctacgctgatttgtgtttaggatgctttggactctctgctgccttgaacggcccatggcttgagcgccatggccccaggctggcggccttcatcggatccactgtcttctttgcaggaaacatgattgctgccgttggtatccacaccaagatcatcccccttctgtacctcggctatggtgtcctcgggggagcaggtctaggtctttgctacatctcacctgtctctgcgcttcaaaaatggttcccagaccgccgtggactggccgggggcttcgctgtttgtggattcggagcaggatcgattattctggccaaaatccctcaacccttgattgcagcagtgggcttgccattgacgtttgtggtcctcggttgctgctactatgccgccatgatgatctgcgcgtttgtgtttcgagtccctcctcctggattccaggtgaatggcatggatatgtatcgtaacaaggtcacgaagcacggagaccttgatcaagaagcgaacgaggctgagaaggccgctgggcagtttagggaccccggcgccaccatggttctcagtgatgccatcttttccaaggagtaccgcattatctatatcatgttctttggaaactctatcgccggtttggtcttcctgtctcgccttgcgaacatcatcacagatatcttcaacaaggatgcggccacagctgctaccattgtcgccatcaacggaggcttcaatttgggtgggcgactcttcttctcgactgtctctgatcgcttgggccgcaagaactcgttctttgtcatgttgctctctcaggtgatcatcctgtccacacttcccatcatcatggagaagcgtgtctactgggcattcctccttgtggtctggtccttgacagcttgctacggcggtggattcggctgtatccctgctttcctctgcgacatgtttggaccttccaacattggagctctgcacggcatcatccttacagcctggtcgttggctggcgttggcggcggtctcttgttcacggaggtgtacaatcacctccttgccaatgggcacacgaccaaggatccttttgtatactcgttcaacctgcggtggatcctcggcgtcgcctgtgtcggattcttgttcctattgtttgtcggcaccaacattcacgacagactgcttcccaaagcgaagggcgagtttgcgcgcctgagggtctttggtcgccttgcgcgtattggatcctttggagtgcgatggatgaccaaggccgaagaggaggccgagtgggagacctatgtggaccagcggaaccagcaggccatggctgctgccaagtctgctgtggcctaggtgattctcaacgcggctcgtaactcgtagtcaataaagcggttgttcacccttaagttaagctttcgccatattagcagaggtgctcggtgctcacttttgagactcctctttcaacagctcaacatcaagccaatcatggtatatgtctaagcaaccttcgatccgcatgggaatccatcgcatccatcgcccatccatcgactgcatcggcatcaggcagcccaatttgcatcatcgacagccggaaaacgatagtcgttgatccatggaagcccagcaaacctttcatcctctcaaccactggaatcggggtctacgccaacctacgcatgaggatcagtagccggcaatcgcgaatccagttcgatcgtccaccgcatccatctcatcctgctcgtacgaccagcgattactcggatccagcaatgcaagtctgacaacagcgttctgacaagagcatggacgatacgctgctccccctttgcaaagaacaggatcaggatgtcaggatctggacccacagggagaaaaggattcacatctcttccttgatacaactcgggaaacggatggatccgaggcggctaattgagttgcggtcttaataacgctctgtccttattttgcactctctatatcaattagtccgctgaagaccagacccaaaagtcgaccaacaccatgcgtgagttgcgtcttgagaagctcgttctcaacatctgcgtcggagagtccggagacagactcacccgtgccgccaaggtgttggagcagttgaccggtcagacccccgtctactccaaggcccgttacaccgtccgtaccttcggtatccgtcgtaacgagaagatcgccgtccacgtcaccgtccgtggccccaaggccgaggagatcctcgagcgtggcctcaaggtcaaggagtacgagctcaagaagcagaacttctccgagaccggcaactttggtttcggtatccaggagcacatcgatttgggtatcaagtacgacccctccatcggtatttacggtatggacttcttcgtctgcatgaaccgccccggtaaccgtatcaccaagcgtcgtcgtgccgttgccaaggttggccccaaccaccgtgtcaacaaggaggagaccatgaactggttcaagcagcgttacgatgggtaagcattgttttaacgatttctatcatatttcccaaagtcctcgctatggcaaccattatcgatgaactaatatcattttttaccattctttttgctttggttttttagtatccttaccaaccgcaagtaaacggttgtgtacgggatagcggacattgcaccttgaaataaatcgcttgaaatcgctcttgatcgcaagcgcataatatacccagcatcaacaggcaggatatgcatcgacatgaagaaacaagcggtattgcgcggttatcgtgatagtgtcctaggaagaagcagagagggtcgaggggaatgtgagaaagtggacggaggccaaaaaagcaagagggtttctctgggcaaacactgatgttgctatgtcacgaagggggttctgtggatattgagaaaggaggaccggtagccgaaaatgcggtagggacaactagaagggggcgcttgtgaggggacggacgcagtgcgctttttgttgttgatacatacacccgaatagctgctgcttcccatcttctgggactcttttttttctttggttgcgaactctgggtaacggcctcgcatcctcttttgtccgattcttcaacaatttgtttttttccttgctcctcgtcgaaccatatcatgcccatacttgcctcttctaaacggcggtcgacacaccgctcgttcctatcacattttgtcttgtggtcctgcagctgctgtgttgtcctcctggctgtgtccaatgtggcctttgctcaagcagacacttccacccttgtcagtccgccacctatacagcagcaaggagccaaagcgaacgcccccgctgctcctcctcctcctccgcctgggacagcgatcaaccatcgacccttcattcctggggtcattgatatgaatgctatagcaccgttctttccttccaaatcaacttcttgtcagctctgcaaggtccagttcccaaaactcgtcgagtgcaatctggtggccaacaggacgttgtccctcatcccacgcttcggggagttcaatcacgtcagctacgtgaacggagaaaggcatggaggagaaggacgtggcggaggagggctggtgcacaagaagcgctccggcactgaagaaacatctccgttcctgaccgtaagcaaacttctatcctcctcggacagttcttcctcctcgagcgtttcaccctccaacttcgatccaaacagtgtcaactttacagctgtgatgccctttttacagtgcatctgtccagatcagcgtctggaggctacacgatcctgtctgacgtgtttccgtgtctcgaaccaacgcaactttttgaacgatctctcggtccaaaatgtcgccagttcgctgtccgcctttgctcaagcctgtgtggactcgaacaacggcacagtggttccgcctggatcgacaaagggatcaagcgctagcgagagcgagctggcccatggctctcacagtgccactgattccagcagcaggagactctttcaagacttgaactggaccctattgagcaccatcatgatcattgccgtggatctgggctatagtctgtagtaataaacagtccagcaccaaactgacaattggaggcgagtgactccaggagagggaggtcccagggactgcccgagtgaaataaggtgtgaaatatgaactctgaaagctgtctcactcaacaaagctgctcactgaaataaattcacacctttctaccctagcatattctatatgtttttttgggcggcctgcttgcacagtttttgtgcttgcttgggtcgcctatcgggtaattcaacactttgcctcgcgcgaccgtcttggttcatgtgaatgcgaactttctaattactcgagaacaactcctgctcttaatcgcttgctgagcgctcaatcaatgcctcagtgagtttcatatgacaggcacagtccttacgcaaactcttcaaacacacaaccaaaaaagaaaatatgccaagtccatttttttatatcatgtatctctacatttggattcgacttgatcgttcggcgtgcacaatcgtcatgagtgcccttagaaagctcgtaaccgtcgtcgtaccagactagcacgaaggagaacacggcaagcagttagtattcgcctttttcactttacccagaccaaaaagcacgaaaaaaagtacctgaatgtgcgccgcgtgtgcgagaaaagggagcttccggatggctcttccactcactccatgggcttcgcgcgcgatatgatttagtgcctctgatactaattcctcgtcgctccccacccctagcttgctgaactgtcgacgttgaatcgctctccactgcaacgcggtgtaatcacactcaagaattcttgcccgctgcaactcctgtaaactggtacacagcatgttgtggatggcacgctgagaaggaagtcccacatggagtttgatatctgcacgatcaataaaggcaacatctaccgagaagccagagaagcatgtactgatggtcaattcaattattttaacatatctgaggaccaaggccatgccatgccatgccattcctactcgcttaccaatggcttctgtgatattagacgtggtgaggatcagcacgtttttgcgctgcttcagtcgatcgatctgtgtgagcaacgcgttcacgacctaaacgagccaaagtcaagcatgttaggcaagcctacaacgaactctgctctcgttcaactctgcgattcaatgcaatggctgtttcttgcactttaccctgagagaatcggagggctcgtttcctgataaagcagccttcctcgctgcggctaaactctccacctcatctattgttcacgatacagaacagtgacaaaagatgttagttagttacgcctggccatggtcctcttccatcgatctcccatatataccgtgaactgatccgctcttaccgataagtacgcagacgaatgcatccttgtcctccaccatgctccagatctggtcaaacattttttgaaccatctttccgctctccgagaaccatttactgaacaaactgtggctgttaatctccaacagcttcccgtatttgaatctatcatcataaatgtacaccgaaaaaaggcgttagatgaccgtcgaccagcagcgatacgtttctgggtaggacttacgattgataaagcgattcagtccgtacctgtttgacaatcgaatcgacagcttctgcgcaagcgctctgcaaagggacgtctttcctgttccaggcggtccgtggagcaacacgaccctgtaaattacaaaatccagatgcgcgtaagagtcaggacgatgaagtgcaaatatcgatccagagacacctgctcctggataaccagtccttggtttgtacctgttccatgagatgaggagtggattgactcccctgtccgaaaagagcatcatcgtgtgcacgtactccaacagctttgcctgaagatcatcatcgaatatcaggctgatattggaagggaaaaaacaagctctatactgtgagtgacaaaaagggcgctccagtgcaaaaccccgttcctcgaccgcctcgaacaaaaagccgccccgttgaagaatctgcttgttttgagcttacttttcccagacgccctccagctcttgacagggcaaggtccagtgatgagccatcatgactgcctctccctggcccgtgtcgtcgctatactcctctaccgcaccctgcgactggatatggtagaagtggatagacaactccttgtcctcggaggtgtataggatttcctgctcctctggctcttctccttcccgagactgaggacgcgatcccgaccactctcctacccacagtcgttccacagcggcccgaagagccggatccgtgcattcgtccaacgaaatctcctgaaaggtgctgacgactttcactgtcgtttttagaaagtagttgacgcgctcccaaagatgccgggaatacgagctttgaggcgagagtcgtgcctcaactattttatggggaaggtgaatccgtgaggaattaaacagttagtgagcggttcgaggcatgtactcatttgctgcgtggttgtccatttcacgccctgtccgctaccctgcaaatatggtggatccatcagtcgagccttagtctggggtaggggggtcgctcgaggttgatgtgactgaaggagagtacgcggctcgagaatgcgatcaggaagaactacgtctcggacatgggatgcgcaacaaaatcgatcaagtagaagaaagactcaaaaaaaaaaatgggcctgaaatgaaagcagattttggaccccagccgtgatcgacagttgaacctcgtccgcgacgcgagttcggagtccagcgcattcttgaccgagtttatagcgtccgtagccatgttggacgcgtacatttgctgttgctgcagactggctgcgtggccaacccagatccacgtctatttagcatgtagagtgtctgcttccatccctagttgacgcgttaatcgtgcctcaaaaacatcaagacgcggcttcattttgtgcaccgtgtcgaaagagtcctagtggcaaatacaaggtgacagagacgttttttattccacacgcaagataactggtttcaaagcttagccttattggcattgaggatgtcgccaagcttggtcgcgagcatgacctgacccttgaccttgatgccaccagacatgaacagcttctgagcattcgcctttccagacgcaagattcacaaagacgtcgtctttgacactgatgaaaacatcaggcttgctcgaggccggtccagtgcccacgcttccctcgccattcttgagatctacatagtaggtagcagtcttgccatcctcgtttgtaatctcaaactggaagacgcccttgaccttcttaacttgtgcggcacggtccgccgacgacatggcctcgatgccagtcttgatctgctcaaagactgcgtccgacttgaaggcgcccgctgtcgctgcaccgtccgctgcagcagctgggctgggacccgcaccaccggccttcagtgcatctccctgaagctcaacagcggcattcgaaatcacaatcacgtcgcgctcaacggctcgcacctggaaaacaaccttgttatcctcgcgccacatcgacgtctccaatgtatcaccgggattgacagtctttgcaaatcgggccttgatgttcttgaagtttttagggtcgttgttgcagtacgtgttgaagatgtgcttgcccgcgatgccgaatgtgcagagaccgtggagaatgggcacttcgaagccaccaacggctgccatctcgggatcgatgtggagtgggttccagtcaccggacagacgatagagcgcagcctggttctcgctagtcttctccttgaccacatggtcaggcttgcggctgggaatctggttggtggcggtggcggcaccacgatctgcgccttccttcttgccaccaaagtttgcaacgccacgaatgaacactgtgatctcattgatgcaaatgtcgtctccattctcgtccgtggtcttgactccaataacgacgacgcatcccttgcccttgtcaagaatgtcgacgatataaggggtcgaaacaagagtgccatgcgacgggaagggcttgataatttcgagatactgctcgccgtgaaggagcatcatgggattgaacgaggggagaatctcgccaaaaggaacagagttcatggacgtgagcgagggaatcacaccaaacgtggggacgggtccgaagttgtcgttgttctcataaacaagatgaagatccttgcgggtggcaccaagacccagattgtagagaatgacatctcgctccgtgtacttgaacgagtctgatgcaaagttgagcgactttgcggcttcgacatccaccttgccgtcctcagacacgacgcggggacgtggcgcctcctccttggagacgttttcaaagttggagataatgccttccatcgattcttgagttgagtctgggtgggttgcgcgaccatcctcaaagttggtgatcacctcccacttttcctgaatctgctcaggcagcagaggcttgtcgttagggaagccatggccgccagtacgctcccagcggagcttgccaataaagccagcaccaacttcaaagagggatccgttctcggcggtggattcatggcagaggtaggcgaccaagggagtgaccatctcgggcttgagggaggcgagcatatcgggaggaaggacggtctcggtcatacgcgaggcggccatgggagcgatgacgttgcagtggatgttgtccttcttgccctcaagcgccagggttcttgtcagacccacaagagccagcttggcagcagagtagttggcttgacctgttcgtggtgagtcgagggcatggcgcgcatatttttagcactccggtgcactggtaataggaagcctaacctggaatattctcgaatcccttttttttacttaccaaagtttccgtagataccagctgccgaggctatagagttgacgagacaagagagaaatagttaaagcactctgcttgcgcccaaaagcaagacgccatcaggagtatatcaggctcttcactgtctaatcgacgtacttgtgttgatgatgcgaccaaacttttgctgacggaaaatgggccaggctgccttgaggaccttgtaagcaccgtccacatggacctggaaaatcagcttccactgctcgtctgtcatacgcgcaaaggacacatccttcaggataccagcgttgttgatcacgatgtcgactcgaccaaaggccttcatggctgtctccacaatcttgtcgccgtcgaggaccgagtcgtagttggccacagccttgcctccaccggcacggatctcctcgacaaccacatctgcagcgcgggtggaggcgccctcgcccgtgtgagaacttccgaggtcgttgacgacaaccgaggcgccccgtgaaccgaagaacaaagcatgggaacggccaagaccgccgccagcgcctgtaacaatcacaacgcgaccatcaaaacgaagggtctctgccatagtgtttcgagttttcaaggaaatgagcttgggcagggggaaggaagagtgcaggtcaaagacggggatggagaagcagggaatcgggagaatggggagtgaaggcaagaagctgaatgggcaaagaccaaacgtgggggggtcgaaaagaggagtctgaaattgagcgcgggccaatgcgctgtcgctttgtaggtcgagcctcaaacgctcaaatcaaacgccattgatcgtgcgctcggcacctccagcagccggctgtccagcccacaacaaggaagcagacgtcggcaagccgagaggcgcattcggtcataaacaaagcaacaacggcgcatgcgagccgggttctcaggcttcggtgggagaaatctctgccggctaccgtaaaaagagttcattgctcagaatcgctcgtggagatggccaggtcgtcttgtgtttgcgcgactcccgtccatgctcctttgactttcccaacttccgctttcgagcatatgaacacgatatggtagtcatcggctcgggcatcgtgttcctccccaccactgacagacatgcaacagcggacgtgtgtgaccttcaaccaaagtgacccttcgacacccctcaatcactcactaaccaaattttttcacacttggtgtgggcgttttccttttttttctctctatcgttctttcgtgtacagtacgggtgagttgtagactatatgcagcggggtagatttgtaggagaccgagggaactaaacagggggatcgcgattatgcactctttcttaatcgtcatcaaagctaccgcgacgccagccaggcgaggagttcctgttgacctcaaagcttggctggttgtgaaccttgtggttcgctgacctcggaggcaaatcctcgtcttcactatcggggttcatgacccgcaggtttctttgacgagagagtatgagagagtgagaggattcagaggttagaaaatatcccatggtgagcgcaccgcccaatatatcaacggcaccagcaagccggaaagccagagtagggcgtagaagacggcaacttacgagatgttggacagcggtggcagtgttggctggatcatgcccgtgtattgaggcaaagctgcctccatgtacgaatcccggtgtgtgtcgctgaacttgtattcgtcattcacgccctcaccccgaacagactcgcgtttcctcctcctccagacatatcccgcgaccgtcaaggcgaccaccaaggcaatgaccgataccacaatgcctgccacagccccgctggagagattattgttggagctagcgtgttttccagacgtggattcatccgatggaacaggcacggccgtcgggcctgttgttgccgcggtcgtgctggcactgggttgatccggcatattgatcgccttccacgtctctccatacgacatgcacacaagtttatacccctccaggtccttgacggagtaatgagctgaggtcgacgactgacatctcatacatcccgttgcctagaatgaaaaaaattggtcagcgctaccctcacaatcatttcatggcatctaaaaatcaaactagaaagaaattggactgtaccaagtcgtagtagttttggttacacgcgcactttgcttgaactggtagtggtctataacagagtgggtacagtacataacatatggcgcttgttaataacaagatgacgaagaccaagagcaaaaggtatgaaaatgccatagtgtgcttactggtacaccatagtcccgggccatgtaagcatatccaaagaggagttgcatgacttgaggagcgtgtccacatgactgcactcggggcaggactctgctgcctcactgctccatggcgacagtgatagcagaacgctggtggagaggagcagtgtccaagcactccggaagctaaaatgcaccattgaaggatgtgtgatggtatataagccccagtaggcaggcgttctttgttccgtgtacgagcttgaggtgccaactctctgcgggctggggttctttaaaaatatacagtggtgaaaaagggacaaattagaatctgtgaagaccacagcctttttgtcatctcgagaaaaaggtgggagagtgagtgaagcagagcgagagtgaaattccagcagactgtcccctgccgctccactgcgatgctttggtctctctttttcagtgaaacgagtttctggctcgatacaccctggcacgaacgtaaaaaaaaaaagagttgctgttcaaggggaaggtggaaacaccatacaacatatgcgaaaagggttcaagggggtgaaaagctgcaataaagctgtaatattcctccatgaaacagttgcaccagcaatgtagagaatgaccaaggcaatgtgctttctttcagcaaagcataggccacataaaccgcaaaaaatgcgctgggggggggggggggggaagggggtcaaacgctgactgacccagaggatggtccgcgcccacagttgctgcagttattctaggttgttcaggtgtgtaatacaaagggaaaaacaatgctcgatatgtcatatgagagcactgaatgcacactgggcacccgcaatgtgcaagcagaagtgggacgaagacatgcttttgaaaatagccaaggtggccggtgcatgttgggatccagggggaggtggctcctgttgtcgctactgttgtggttgtttttagaaagaggctggagggggtggaggaagggtttagagggcctgtgaatgtgaggtggtacttacaattgatcggtgatgtgaatatgagagagaagtcgatccaaacaacacgggagtggtgtaggaaatggtaatgcaagcaaagaacaagagagtaggcgaatgagggagacggagagggcgagcgacagggaaggagggcggatgaagaagaagctgagtgttcctgaaagacaggaatgtgaaatagtcctggatctgtcttgagaggagctatggcaacgatgagaagactgagaagacaaaggggatgagggctcggtggggtgttgagccttgaagctgtccagcgctcgaggcacaaacagaaggaagaataggggacaggagggcctgtgtagacggatgagagcgacggatggtgagcgaaaggtgaagaaaaaagtgaagaagcaaacaagaacaacaacaacaatgggcaatgggatggggtgttgcgggaaacaataaaaaaagaaaaaaggaaaccggtgctccaaatatccatccgcttcagccatctactggcgggtgctgaggatacgacaatgcacacagtggtactcttgccgtggttcccatttcgtcaatatggctatttttatcattgttctctcccctcccgaaagaccatcatcggccgcctgacaaagcgacgcaagggcagggcgcgttgtcgtgccctgccgtgccctgccataccctgcccatcgccgcgggcattgaaaatacgaccgtggcgtcagttgattgtctctggtagctgacgcctcgtgtgttttgcccttcatgctactgatgcggtgagatcgataacgaggaagcgaaccctgacgaagctagttgaacaaaacttggacggacaataaacaaagactccatggcacacttctagacagtctgtctggcctgacctcccacagtctgcgccagcgcgagtctgtcgcgtttatcctccttcccccccccccatagactcgattaggatagtagatgtgaacacctaaaccaagccaatgacaaaagcactgtcgggggggggggggggggaacaatctcgatccgagcgcgcgagaacgcctctgaggccagaaccatcccatggggcatctacacaaagccttgcataaagcgcaaaatgctgccatgtgccttgaacaccagcgacattcgcttgggcgcgcacaaagagtagagccggaaaaagtgtgtatattcatactacagtagtatctaaattttttgatattccagtttgccttccagcttctttgcgtcagctaccttgcgaacggctttcatgaaatcctcctgtaccacgtagtctcgctcttcacggattgcaaacatgcccgcttccgtgcagatattgcggatgtctgctccattgaagccgtcagacaacttgacgaccgcctcataatcttggaaagtaaatgaaaaagaataaaaaaaacaaagaggagggtaaaatgtgcttgagcattaatcacctggttcgttcacaagaaacatggcaagggtttggccatgaaaataattatacctatctctccctgtttggtgataccaagggcgtgaatcttcagaatctccattctaccctgctcgtttggtagagggatttcaattttgcgatccagacggcccggtctcaacaaggcgggatccagcgtgtcgggccggttagtggccatgatgagcttggtctgtcccaagtgatcaaatccgtccatctggttcagtagttccataagcgtacgctgaatttcacgatcggcagagcttccctctgagaaacgacgtcctccaatagcatcgatttcgtccataaaaatgatacagggctcatgctccttcgcataggctaaattgataaggcacaccaagtcagtatctatttcatcattcatcataggaggaaaaaaggcgcccaaagacagcttgactcgtaccaaacatctctctaatgactctggcgctctctccgatgtacttgtcgacaatggccgaagacactacttttagaaagttggtctctaacgtgctagcaaccgcgcgcgccaacaacgtctttccggttcctggaggtccataaagcagtacacctttggggggtttgatcccaacacgcacgaacaactcgggattcatgaggggcagctcaataacctatgtttcagtcgtcgttgatcaagacgaagaggaatagtaagtcgttctgctcggtatggtccctcctcctcctcttcctctcaaaaaaaaagcttccagtttcaatcgactgtttgccttacctccctgagttctctgatctgttcattgagtcctccgattcctgcaaacgatatcgctcctggatcttccatgcccatgctatacaccatcgggtcgacttctcttggcagaatgcgcataatggtgaacgtcgtcatatcgagagctacacgtgttcccagcttgagctttgacttttcgagtttgctgcgacatccgactacatagcgtggaccgctggcagctttgatgatgactacatcgatgaaacgatagccatgacaatacacaggtcattagcatgagacacgtccagtcggtaaggtgttagccaaaataaccctcaaggagcccggatatgattagcaacatacatcggtcctcgtccagctgcttcaagacggatccaatgatttgaccaacgctctgtaaagccttgatgtcgtcctcagacttgtcgaaagcacggtccagctccctgagacccatgcgcactaaccgcaattgaaattcacaatgaaggggggttagtgatcctgctcagcatactctccctctgtccagattgctcatcctgctaatgagtgcctcctgcccattgactcctagaaagtgcttgatatcgttgcaggcagagcatcgaagcttaaagcacgaaggatcaggacatacggtcttttacttttgtttccatctcgcgatgttccagaagttttctgcggtagttggtcaaggctgctgctctgacgtcgccgtcgtgtgctgatggagctgttgccatggcgtcgtctgtgtgtgtggggagcaaaagagtcgtgttgcatgcagcgggcgcgtccaagttcagaagagctcaagggcagcaaagccacctcaccgctcaactaaggttactgagccacatatatcaaactggcgggacgatcacaatggagaacccacccattcctcctgacagcagcgcgggcctgaaagactggaatctcagacggccatgcagtaccaacggacacctcagctggagaaggtagcgaaatacaaacgagagaaacagtggagcatgcaacatccttccagcttctgagcatccaacaatgaggcgcatgactcagcttcaatcttcagcgacactgacaaagaccaaaaacaaaaaaaaaatgcgtttcccctttccacttcactcttgcgcccactcaacgtcccccgcctagaccatcgctggcttcccctcgctcaagacaagggaataccgcgcacacaagtccaatgtccatactgttggatggaactgtgacggcagaaaattggcttcaggctcgaccgataagactgcacgcgtctgggcgccagagagaacagtaagtctgcagtttctatacacgcagcgcgcgacatattctcctcttatccaatcgaaagcaatgctaacgacactcactctcgtctgcgttgttacctcatatgacaccttcaagtcagatccaaggagctcgttggagttgcgtggacataccgacagtgtggatcagctacgatgggaccccacccacccagatcatcttgcaaccgccagttgtgacaggaccgtccgcatttgggacgcacgttgtaaggagaagatcacgcgcggagactttttttttgttctccttgtgaaagtgtgctccatcccgacactagtggtgtcatcacttttatacacagtttttgcttaccttttatgatttctgaccatcgttagccgcgaagagtattcacaagatcgacactgtgggtcaaaacatcaacatcagctggagtcccgacggccatagcatcgcggttgggaacaaggatgacatgatcagctttattgacacgaggactttcaagatcgaaaaaaccgtgcagttcaaggtcgaagtgaacgagctcggttggaatcccacaggaaaattgttcctcttgacgacgggacagggcacagtcaagattctggactatccatccatgacagagttacataacctggatgcgcatacggccaattgttactgtttggagtttgatccgcggggaaggtaagcaggggacttctcgacagttgacaggcatggaaaggaccgtttgttgtagcacgacaaaacgactcacagggcttttcataaccaatgcattgaattcttctagatatttggcgacaggaagtgcggatgctctcgtcaatttgtgggatctggaggagtatgtttgcgtgcgaacctttggacaattagagtaagtgaaacgttgccggtcctgccctttcatcgttgacgcaaaaagctcttcatcgacgggcaagctaaagctaatgaataacccactgccttcatagctggccaatccgcacactcagtttcagtttcgacggcgagttcatagtctcggcctctgaggatttagctattgatatcgtaagtctcttctacaacagcagaccgaacatgccacagactctttcctgcggctggcccatcgaaactacatttctcacaaatgcaaacaaccacctttttttttatgtagtcgttggtggagactggcgaatccgtgcacaagattgattgcatcgctgccatgaatacggttgcatggcatcccaacaagtacttgcttgcgtatgcgggcgatgaacaggagtctaggcccggaggatctgtcatgacaggaagcctgcgtgtgtttggattcagcggctaaagcatggctaccgcgataagacgccgcaaaacattgtacaatatatccattgttcgttctaatgtcattacgcgcggacgacttttctcactctgtatctgttactgtcaatgctcctgctcctgctacagtactcggatcaacatcgttataacatccgcgttggactcattaattcaacgttcctctgcatccgcgagagccgcaaagacaagggatcttgtctgcctcgatggggaacttgtagtcatacgtgatctcctccccttcctcaatgtccctcttggcatagatcacaatcttcttctggccatcgaccgtaataatcttggcgttgcagttgggctgacataaagcgaaagtaaacacgtagacagatcagcacaagcgaacatgaaaaccagatcatagatcagcaacagcagcagcagtaacgccacagtgacttacagtgcagcagtggttgatgaagcgagcaatgttacccatcttggtggcatcgatgaccgtatcgtcgtcaactcggaacaagtatgacgatccgatacccatgcgctcatagcgtttctctcgatggtccgccaccttctgacgaatcacctctccaatgtactcaatgaccatgtcattcgcgtcgaccttctccatcgcaaacaagccccagtcgtggatgggcgacttggcgaaccgaagttgtttcttgcggaccttcagctgattgaacttcatgatgtccgaatccgtggccatacccacaagcatacgtcggttgttgactctgttcattctggacgaaatcctggccgcggcagtgttgttggccttggcggtgttgcgatgaggcaaataatgcgccttgtccagctccgagatcttgtaaaaaccctctgtgcgagcagatccagtctgatgagctggcggttcctcatcgatccttgcgtgattctgcagagccagggtcgactctagctctctcagctgctgagtctggttatcaacgtcaccgataagaccataaccaggccctccattgcgacgactcgactcttcatcctcggccctctttcgttcaatctccagcgccgccttcatgaaccggaaatcttcctcgtcgccattgttgaactgcagaggcattatatccttctgacccatagccatggcaacgtcgcccttggtagactggagaggctcgtagagatcaaagtaagacgaatccgagtccgtgtctgactcagatcccgaatctgtgatcgacacagactcagagtagtcgggtgtaccgtctcgaggtaatgcagtaccatgagtgcgacgttctgcagaaagcggcgacagtggtcggtcctccatgatcacgtcccgagattccacgtccgatcgtccgtcgtcttgacgcttccttgccttctctgcctgctgcttctttgtggtcaacgctggtttcttgaccttcttggttgatttgcgtgccttatcaccgccggtctcgtagtccgagccagaatcggcatcctggaggatgacttcgtccatgcccttcctgccgtcagtttcgcccttgctggtctggtcgtggagacgctttctcttgagcgaggccttgcccggtcgaacagtctcatcagccgcatccgcctcactatgccgacctcttaaggctaccacctcatcgtgctccgtgccgtcgtctcctgcttcctcgtcatcgtctattctctccacctcttcctcgtcgtccacgataaactttacatcttcatcaacgtcatattcgtcgctactctcgctgggtggttgtcgctggtggaactcggtcaaaaaatcatccgcgtgccgcccgtcgtcgctactactgagatagtcccgaagccgctgcggttgcttcttgtttccttgtgattgttgtctcttcttgttagaggaccgactagacttattgctcttcctctgtaggcttctgcgtgatggtccacgatcctcatcctgactcgaagaactacgagcgcccttggaatatcggcgcgacttgtgcaaaccctttgactccacgtagcgcacaggggggcggcctctggactggcttctggaggccgagcgagtgccagatctagatcgcgagcgtcctcgaatcttctgtgaaggccgagattgagagtgagagcgtgaacgcgagcggtatctgttgcgggagccggagcgtgatcgggaacggggagatcgagaccgcgaacgggatcgagagcgagaataggagtggttcctagatcgacctcgtcgactagactttgacttggcggactgcttatctcccctgtccgatcgaggctttcgcgttactttggaatcaggctgcgtcctcctcttgaaactggggagctttggaagagcatccggtcgagccagggggtgcgactccttgaatgacgatgcaatatcctgtcgatccagtgtcggcttcgtggaaacagcgtcgcggacctttgaggagcgagacagtgtttcaggtcctgctttcccgctgtgtagatcatccagcccagaatcgacagtcgtctccggcaaagaaagcgatgattcgtcaagtaaatacgatgtggtgcctttgtcctgcgcctgaaccgttgactgcttctgtgcacgctcaatttcctttgccttccgtgttgctgggtttaaaaagtcgtagatagaagggccaatgacgcggttgcccaggtccttcaggaacacctggaaaagctctcgcatgatcatgtcagatgcccagcggacaagagactcgtcctttgatggcgccttagtgcgggagttggacaccgatgagacgcttgccttcctgatggcgaccgaggtgcgacggtttcctaagtccttcacagtacttttccttggcagaagctccggcggcagcttgtcgtcaccaggttcgtggagtgtgatggagaccttctgaccgagaagcggcttttgatccaaaatgacatggcaccttcttgcctgggctagcgagacaaaacgaatataccagttttctccatggcgctcaatctaatgaccatgaataaggcgcgggctgttagatcaagggacaacatatggaaggggcgagcccaagatgtaagaaggccaatcacccttgaacaagtgagacttaccctctccggaccgtatttgtcaaatttgtgcttcatgtcctcgacagatatccgatgaaatggcaagcagtcgcgactgatgatgagacaggctagatcgcgctcccatcctgagccttcctcttcgaagccagggccgcgcttatccatgtggctgcgaccgcgcctcatgcccatgtcacgtatcataggatcgtgaccccaaacaggactggggcttcgctccctgctcctacttcttgaccaactgcgactaaggctacggctcgagcgcctcctgcctgggtagcggtcatatcggtcaggaggaaactgcatatcggcaaagtaacctcctcggcggtcatagaaatcgtcccttaatggcggtccaggggctgcccctccttgttttatccagtctggtctattgagcgatcctggggagagcagagggggtggtcctgcgcctgggcggtaagactccatttcacgtccttttgcagaggctctgtagttctcggcaaccggcagatggcctacatctagtgccttttctcgttcgcgcctgggtgcagggagcggaggtcttgctcctggagctgtcgcgttaacacctgcaatgatattggatgcctttgtccgagatgcaccgacgtcagcctcgccatcctccttggtgataggcttgtttcctctcacttgatgcagtgctggaggaggaatgggtggcaaagggatgcgcgtgcgcgggttcggtggaagcgggatcggcgtacgcttcggtggggccggctgagtggaattagaggacgtagcatgctcgtgctgatgagcggctttggagtgtgtggagtgtgtggaggaggcgggtatatgagagggaagagcgttgatggattgactcgaggtggtgtctacggtagaagacggcggcgcagttcccgtcgcgttgagtgaaggctgggttggggaaggcgacagcatcccacttggcggaggagtggaggcgtcatcaatttccatgtcgtcgtcgttggtgtacaggtcgcgatcatgactggactctgcagcgagcgcggcttttgctttagcagcctcgatccttgctgctacgttggcctttgccttgcgaaactttgagccactgccatctgttatcaccttcaaaggccctctctccatttgcttcccgtgtagcgtatcgactgccttcttgacagccgcctcggcctcgggtcctgcaaatacgacgcgtccgaaaccaagacccgtccccgtcacagggtgcttctcgatgatgatgtccaaaatgtcgccacatcctgcaaagagaatctccaggtccaaagcggttgtcgtaaacgccagatgagatatcagaaccccatgctgcaaaagggagttgttatcacgctgccgatcgcgaatgtaacaagaaaaaaatccattagttaaatcagcccgctgatgagacactacggcaacactgtgcactgcatcctctgcatcaaacgcgacccgttagccacgcacctcaaagcggacagccgccagcgttcccttgaaggctcgtctcgttttggagatgaggtagctataatttactgcagtgcggcgcggatcctgtggatcattcttgtcctgtgatacaattgagttaatgttaggttgcaactgcaagggttccctgggggcatacggaaacagaaaagtacgaaaaaaaagggtccgctagaaagacgaatgctagttcatatttacctcttccgtgagatcgtcctggtatcgacatattacgctggcatttctcgacttgcttgcatctaggaacgggtcgtagagaaccttgaagttgcgcacgctagacgagctctcgccaagcgactggatgggtctgacggcgcttatgggaggcacctgctgaaagcttgcgcccgcagcgttgctgctgctatgactgacaccgctgccatccccgctgttgatgttgatcagcgagccagtgctgtaagccaacgtgctgggcacatgaacctctcctgttatagatccgggtcctgtcgatcccgtctttactgacgctggttcgggtgctgctgccgctgctgtggtttcgggtgcgcttggattctgcgctgttaagggctcgatgtcgatgctgccaatagcggtcgagtctgtcggggtggtagcggttgtgagggtagtgccgttgctttggctactgctgttatcgctgtcgtggctgccaccagtgctattcgacggaaggggcggggtcgaatcaagcaagctcatggtagactcataggctcacgatacgggtggaggcgataagatgtctgattatgttgaactggggacaaaggcacaagagtagattgacgttagacaggtggcagtctacagtataatcgtgatcgagattgcaataatgcgtcaaggctggaataacagaagaaaaaaaaaagtacgcgttctgcacaggttccaagctcctccgcgggtcataacgacggctgcaggaagcagccaggggcaggatgggcgccaagacaacaacaggacgggaatgcgggcaaggatgatgatggattcggacagccggcgcacagctagtcctcagggaaggcagcttaccttgagcgaaatgaaatggagggaaaacgcagcgatgcggatggcggccggacagtgggcaaacaatcagcgatgagccgagctgcttgcgggcgagagacgacgggcggcacacggagcaaggcgatggccggagagggcaggctgatgagagaggggacgggcgatgagaggatcaagacaaagagagggaagataaaacgagcgagcgagaaagagaagcgagattaacagaaacaaagacgaaaaggccaagatgggaaaaagagaaaaacgagagaatgggaagaaaaaaaaagagtgccagtaggtcagagtatattttgtgtaaacaagcgcgcgcgagatcagcctggtgcatcagacaccttcatcccaagcagacccgaatgcaggctgtgcgcaccgcggcagatcatcgccatggggtcctgccctgttgccacacaccacccccttttgagccaagtgctccgtgtgtgtgtgcgctgcttgtggacaaacgcagctggtgtggtctctgtggggggggggggggctgaatggcaaggcgacctgcaggcctgagtgggatgcacagtggacccaaatagggatttctttccaatccgttcaatccttccctccatccttctcctacacacacaaaacacacactctctctctcacttgcattcttccaccacccagcagccacaatcaacgtatacccagcaagcgcacaatcgaccatggctgcacctgcttacactcctgtgccgacgaataatcccttttcaggctcgtttccgctgccaccgacagaccagtcgcctgccactctgggccttggctacatcaaaaagttccgcgaggagcgcttgtcctcgctgcggcccttctcggagttctttgatgtcaaccgcttctcaaagcctgcaggactcgtcagtgcgtagtgcctcggattcgtttgcactctgtcctgcatatcgcaacaaactctcaccccaaacaccgccactaccactactagatgtaacctcgcggttcaactacaatctggcctacttccaaggcaactacatgctcgtgttccttggtataaccgcgtatagtctgtaagaagttgcccagtgcatggatcacagagacctcggccaggacagagtcttaacaactgatattataaactttactactgctgtcgtatagcatcaccaatgttatgctgatgttcacagtcggcgttgttgttggcggaatgcattacatctccaaggttcctccagagggtgttgttatcgggaaaactacatacagcgcgcgccagttgcagacgggtcttgtgtgtgttgccgttccactgttcttcttcagctcgacgataggcaccattttttatatcatcggtaactttcatgtccagattgcgctccggcaccatcagacgtgatctacgtgtactaagacgcgcttccctgcttacccttccacaggcgccagtgcggtcagcatcctcggacacgcggcattcatgcaggagggtgtagaaggggattttgccaacaatgtctgagcacagaatgcctatcaggatagaagagactttgaggacatcaaagaagaaagtgggtagcagctttcgagtagcgatatagcgagatagcggcacgagaactggatagacgtgctccgcaaaccaacattgcatatgaacggctcaatggcaagccaaatgaacagtggactgtatttacgtatgtgtacgtgattatcctatgaatatcctctttgttctctggttcctgcttcctcgttccctcgtttccttcgttcgttctcatcacgcccgctttcgcacccatcctcgcgcctttgccatacactaggagccgcgcttcacacccataacagacacgcacgtacacgcacacgcagacacgcacgctcagactcaggcacacacttgtattcacccgaccctccctcgtcaccctgttacgcctcactgtcctcttccctgtccgcacgcttctccaccgcagctcttgatgaccgaatccttgcccatccgcttccaggagcatgtccaggtacacgaccacttcagtgcagcgctctgtatgcttcccttatctctagacgcgtgtcgagtgtggacgctgatgcacgcctcgttcaccctgtttagctccaaaacctgggcataaatgccgcaagcataggcttcaacaccttgacgcttgaatcagatcgcttcatctgtgtccgcgacacgacaggtgaacaaaacctggtggtgatcatcgacttgactgatcccaccaatgtcatccgccgccctatcacagccgactctgccatcatgaatcccgccagcaaagtcatcgctttaaaaggtatctcagtctgaacagttacctacgcgcgttcagaatgctgctgctaggtgatctcggcctgttctgcttacaacgtactgaccacggcgctatctcttgacgatgtagccgggagacaacttcaaatctttaacttggagatgaagaccaaagtcaaatcacaccttatgcacgacgacgtcgagttttggaagtggatctctttaaagtcactggcgctcgtcacaggcacttccgtttaccactggtccatggagggcgactcccagcctgtcaaggtgtttgatcgccacgccagcttgactggtagtcagatcatcaactacagagtcaactcggatgaaaagtggatgcttcttgtcgggatttcgtcccaggtaagcaggcggccatgggagagtcgatcgtccgtactcctcagactatgcacgcgacgcccgctcagagttctaacctcttactatctttgaccattttcaacaacctgtagggtggccgtgttgtcggcgctatgcagctctactcaaaggatcgtgccgtcagtcagccaatagagggtcatgctgccgcattcgcagagctcaagatggacggctcgagctctgcgacaaagctcttcgcgttcgctgcccgcacagccacaggcgccaaggttagtctctactaggcgacagcttacgcttctgccggtgcaaaacttccatcgctgactttttgtctttccgctgaatgtgtgacaaccccctgtagctccatgtggtcgaagtggatcacaaggaaggaaaccccgtatatcccaaaaaggccgtcgacgtatacttccctccagaggccggcggtgactttccggtggctatgcagattagccaaaagtacagcatcatctttttggtcacaaagttcggctttgttcacctgtacgatcttgaaacaggcacttgcatctacatgaaccggatcagtggggagaccatcttcgtcaccgcggaacatgaggccacgagcggcgtcatcggagtgaaccgcaagggtcaggtgctatctgtgagcgtggacgaaaacaacttggtgccttatattgtgaacacacttggcaacacggaactggcattaaaggttgcctcgcgcaacggtcttcccggcgcagacgatctgtaccagcagcgatttcaacaactcttccagagcggggactttggggaggccgcaaaggttgctgctacatcgccccaggtaaagctcgatagatcagcgtcagagcccctacaatgactattacccgatttctcacatccttctttgtttttacaattcattcagggcatcctccgcactcctcaaaccattgagcgcttcaagcaagtcccggtggctgccggtcagctctctcccatcctacagtactttggcattctcttggagaagggtgaactgaacaagtacgaatctctggagcttgcgaagcctgtccttgtccagggccgcaaacagctcctcgagaagtggctcaaggaggataagctggaatgcagtgaggaacttggtgatatcgtcaagcagcacgatttgaacctcgccctctcagtctaccttcgagcaaacgtccccaacaaggtcattgcatgctttgcagagacgaaacaataccccaagatcatcttgtacgctaataaggttggctatacgcctgactacgcggtcctcctccagcacatcatgcgcatggaccccgataacggtacagaattcgccactttacttgccaacaatgaaggcggacccctggtcgatctggagaaggtacaaatagtgattcgtaatagcgaggaatagccgtgcaagcgcataacgcaggatactaacgctttttttttctcgtaatgacattttaggtggtagatgtgttcatgtcccagaacatgatccagcaggccacagccttcttgctggaagccctcaaggaaaacctacctcagcatgcccacttgcaaacccgtttgctggagatgaacctcatgcacgctcctcaggtcgccgatgccattttgggcaacgagatgtttacccactatgaccgtgcctccatcgcctccatgtgcgagaaagctggactctaccagcgggctctggagcactacactgagaacacagatatcaaacgagtccttgtccacacccacctcctcacccccgactgggtgatcgccttctttggtcgcctctcggtcgagcagtcgctggagtgcttgcgcgagatgctcaacgtcaacatgcagcagaacctacaaattgttgtccaggtcgcgacaaagtactcagaccagcttggtgcttccaagctcattgagttgttcgagtcctacaagacgtttgaggggttgtaccactaccttggctccgtggtcaacctgagccaagactccgaggtcatctacaaatacattgaggctgcttgcaaaactggtcaaatcaaggaggtcgagcgcatctgccgcgagagcaactattacaacccggaaaaagtcaagaactttctcaaggatgccaagctgtccgatcagctaccgctgatcattgtctgcgaccgcttcgactttgtccacgacctggtcctctatttgtaccagaacaatctcgccacgtacatcgaaacctatgtgcaaaaggtcaacccctccagaacaccagtcgttatcggtgctcttttggacgttggctgcgacgagaatgtgatcaagagcctgctgatgtctgtccgcggtgacatgcccgtcgtagagttggtggaacagactgaaaagcgcaatcggttgaagcttctcttgccttggttggaggggaaggtgaacgagggcagccaggatcctgaggtctataatgccattgccaagatctacattgacagcaacaacaaccctgagcccttcctcaaaaacaatgccgtaagtcttgtatggcttcgagattgtctcgaggtgcgcttctcctccttgctgaaaactgacacacatctccatcgcctcgatcggcaatagttttacgatcccaggaccattggaaagtactgcgagaagcgggacccatacctcgcctttattgcatatgaacgtggacagtgtgacgtcgagctggtggagatcaccaacaacaactccatgttcaagcatcaagctcgctatctggtcaagcgccgcgacggcaacctctgggcgcatgttttgagcaacgagaaccctagcagacgtgcactgattgaccaggtggtggcaaccgccctgcccgagactcaggaccccgaggatgtctcgatcaccgtcaaggcattcatggctgcctatcttccgaacgagctgatcgagttgctggaaaagattgttctggagagctcggccttcagcgacaaccgtaacctccagaacctgttgattttgaccgctatccaggccgacaagtcgagggtactggattacatcaaccgtctcgacaactttgacgcacccgacattgccgaccacgccattcgcaacggtctttatgaggaggcatttgtcattttccagaagcacgacgtccatgcaagcgccatcaatgtattgattgagcacattggcagtatcgatcgcgcatacgagtacgccgaaaagaccgacacgcccgaagtttggagccgtcttggtaaggcgcagttggatggtatgcggatcaaggaatctatcgactcgtacctgcgcgccaacgaccccaacaatcacgtcgaagtcatctctattgcctcgcgcgcggacaagtatgaggatttggtgcggtatcttcagatggctcgcaagcagtctcgtgagccccacatcgagagcgagctcctctttgctcatgcaaagacgggtcgcttggccgacatggaggagattctcaacagccctaatgctgctcaagtgcaggcgatcggagaccgctgttacgaggaaaagatgtatgagcccgccaagattctgtactccaacatttccaactgggcgcgcttgtccacgactctagttcacctgggcgaatatcaggctgcagtggatggcgcccgtaaggccaacagtacccaggtctggaaggacgtcaatgcggcatgtatcgaacgcaaagagttccgcctagcgcaagtttgcggcctctccttggttgtccaccctgaggagttggaggagttgattcgcttgtacgagcatcagggttactttgaggagttaatggcgttgttggaggcgggtctaggtcttgagcgtgcccacatggggatgtttacggagttggcgattctgtacgcgcgctaccgtcctgagcgtatgatggagcacctcaagattttttggtcgcgcatcaacatccccaaggtgatcacggcttgtgaggaggctcacctctggacggagctcgtgttcctctatgtgcactatgacgagtacgacaatgcggccatcacgatgatcaagcactcgccggatgcctgggaacatggagcgttcaaggacgtgatcgtcaaggtttcaaatctcgagatctactacaaagcgcttcggttctacctggatgagcagccaatgctcttgaatgatctacttgcggttcttgtgctcaggatcgaccataaccgcgtcatccagatgttccaaaagtcggacaacctgcctttgatcaagaactacctggtctctgttcagtcggtgaacaaccttgcagtcaactcggcctaccacgacttgctgattgaggaggaggatttcgatcgtctgcgcaagtcgcttgacacctactccaactttgacaacattgcgcttgctaatcgtcttgaaggacacgagctcttggagttccgtcgcattgctgctcatctctttaaggtatttctttgtttgcttttgctcttcccgagaagagacaaagaaatggaacttgacgagaaacatggacgccctgccatccccattatgtctgccaactttatttatacctttttcgattcatctcatgtttacagcgcaacaagaagtggagacagtccatgacactctccaaacaagatagactttacaaggatgcgatggagactgcggccgagtcaagagacacatcagtggcagaggaactgttgcagtactttgttgagagtggtaacaaggagtgttttgcggcgtgtctctacatttgctacgatttggtcaggcccgacgtggtgatggagcttgcttggaggcaccagctcagcgactttgcgatgccgtatatggtccagttcacgagagagtacatgagcaaggttgacaagctagagaaggcgcatgaggagcggaccgccaaggagagcaaggagcaacagcaatcgagcgagacgccgatcctcggaccaggagggctgggcaacagcaggatgatcacggctggaccagggatgatccccgctcagcagaccggcatgagcatgggtatggggatgggaggcatgggcatgggcatgggtggaggctatggccagacgagctatggcctctagacaactttatcatagcccgaggcgtgacaaaactacgaaaaaaaagtataaaaacacaagcatgttcccatgaggtcacgtctttgttatagccatgcaagacatctgtgtacgcctcatgccacacgtaccgccgcgtaaacttttaaaggcatggctccatacgtatgctcaatcttccagcccgtgtcactccagcgtcgcgccctcgtgcgagaacggatgtgccgcactgcactgtttcgcgctgcagaggtggtgcagcatggcgacgacaagggagtgctcggcttgaccaaaagagagcacccacactgacacggcagggttgctaatttgagtcgcaatgtgtgtctctgtggggacgtgggtgtctcagcctcgcgcaactacgtggcacgcacgcccacagacaaggcagggcctcataaagccagggagcggtgctcgtttctgcacctctctccttctcgttccccctctacctcgcacaccaccccgtcgacacacacgcaccatacccctccgacccagtgcgatccccacctcctcgccgtctcgccttcgcgccccgtcacctcctcactggagccagtctgtccaccgccacacccgcacacccgcacacccacacacgcatatactcatacctatactcacacaagacgaccttcagcatgccgagaacgttctgggccatcttcatggtcttcattgccatcgcggctggaatgtactacaacaaagacgacatgcgccccttgtgggagaaagcacagcgggaccttcccgttgtaatccctgtagaacacaagaccccagctcagtgcagcaatgtaaggcgacctttttctgactttgttttcggttttttgtttcaagaaaaaacacattcgttgacaggatgctcgaatgcgctcaccaaccctcttgtgaacgtgcctctttcacgaccagccctctggactgatcggagactcgtcctgctgcgactacgagactgtcgggaaactcaacgttgacttttcatcaaagctgcacgaggtcgtcgatatgccctttttccgctacttcaaggtaaactaaagccctgatatgaggatttacactcgattcccatgacgatcatcattttccgtgtttgtgcgacggacgtgaatgatttattcactcttattttcccgctgatcgtggccaccttatcttccccacctcctcctctaggtgaacctgtacaagccgtgtcccttctgggataacgctggcctttgtatgaacagggattgctctgtggagaccatggacaaggaaagcgttccagaaaaatggcgatcgcataatctcggcaagatctcgatgcccacgaacccggtaagagtcgtggcatgacgtgatccagtagcgtttgaatacttgccaacctatcattcactcacccgtggcttccgccttgaactatagttattccagtctcgaccagccaagctctccatcaaggatcaggagttttgcgtgcccgatgtcgattcggacgaggtctatgtagatctcaaagacaatcccgagaggttcacgggctactcgggtccatcagccgccatggtttggaaggcaatctacgaagaaaactgctttgatgtttcgagggaaatgactgcggggtgtcactactgcgaaacagaacgacaagaattgaaggaccggcaggaacacccatcagcagaacgctatcgcgtcaaggaggagagcaacatcctagtaccacctgagccggcgccaatggaaagcagcaagccgtctagagagcagatgaacgaaatcttttcaaaggtcccaaagggcaagggtgacctccaacagctcatgcaaggcatcgccaaagatggccctgaggagtcttgcctcgagaagcgagtctattaccgtctgatctctggtaaagatcgctgtgcctggattcactctttttgttgccttgtctcgttttatgtttctgtttccaggatcggacatggcttgactcacccttcctacgtttcctttctaggtctccatacctcaatctctattcacatctgcgacgaatggttcaaccagaccacgggtgaatggggcccaaacctcgactgcttcatctcccgtgttggcattcatccagagcgtctggaaaacatctattttgactatgccgtagttctgcgagccatcaccaagatctcggactaccttgctggatacgagttctgcactggcgatgagtctgtggacaggaatgtcaagaaggttgtgacagaactggttgatctggtcaagaagtgccccccgacctttgacgaaaagttgctattccaagatacacaggacgaagggaaacgactcaagaaccagttccgcgatcactttagaaacattaccaggattatggactgcgttggctgtgaaaagtgccgtctgtggggcaaagttcaaaccactggtaagggcgagtttgtatttttgtcccagagggagtttgctagtttcggtccatggcagaacatgccgcctaacactttccatgggcgcgatgatgaacctgttaggtcttggaaccgctctcaaagtcctattttcatacgacgatgcttcactcaagtatgtactcacgcgccacctcatgactgctgcggcaatcccgtccggtcgtggtttcgtttgttaacatggttctcgtttttctaactggctactctaaaactaatagaggagacaaggctgaaggcgtcctaagccggtcagagatcgtagcgctcgtcaataccttcaatcgactgtccgagtccatctctgcgatcgaacgattcggagctatgtatcaagaacgcttagaaaaggagcaggcttcatcttccgccgccatgggacagcagcagcagcagcagcagcagcagcagcgatcgtttatcaaagcgcctaccaaagaagaagatgaccgagacgccatccggtacaaggccgtactggcaagaatcaaccgcgagctcgcccgcgcttacaagaagctggatacacttctggagagcaaaaacataacgcagcatcggaccgctctgagaaatctggcgtcatggatccactaaagaagatatgagagaacagaaaaagactaaatagagactcgcacaaatgatgtacagatgacatatctatccttgacctgtggatctgacaagggggaaaggatgcttgaatgaatcatgaggagtagaaaggcccggtccaatcgaggcgtcatcaattcagcgtgtagaagtgccgcgcgctcaaactccagctaatttcaaagtaggaaaaaaaactgtggctctctgatggaaaagataacgcgaccctgaaaaacattaatggagaagctgtcgagggagagagaaaaagcaaaaagacagaagcagcgcacgccgggagatggaccatgcgcgaccaaaaggcaaaaagagaagggccgaaccgggaattgaacccgggacctctcgcaccctaagcgagaattataccactaaaccatccggcctgtcttggacagatgttttcgaagcccgactttggtccctagtagccgcgagtcactttacgttacttcctctcatatctgtatttccttgcaagtctatgtcacgtttactctcgaaccccgcataattgaccaaaccctccataattgactgaaagtgggtgacttggtggccatcccactgactcgttatttcatcatctccctattgaacagcacctcgactagcacctcccttgccaccgcctcttcactgctcgttccatcctcatcgatactctcttcaccgcgcgtttcttttggctccaatccttcgccctcagcttcttggccttcaaattcttcattgtcagcttctctatccttgtctttgtccttgctgtctcttccttggcctctttctacaattccaggaccacctcctctgctcctcctcttcctcttctttttgcttcggccctgcactgcatccaccacacagcaatgcggtatctgctgcactcttccccgcgtcttgtcgcctcgtctactctacttttcttctttcctcctcctactctttttctttttcttctctctgccctgcttcaccgctggtcaaggacgctcgctgcgcttgccatcaccctgtctgtcttccagaactacgacaatactctccactctcaaccctctctttcacctcctcgggacaattcagtccgagtccctcttgtgcagagacaacaacattcacactcacactcacacccacacccattccctcccttgaccgctttcacgccactaaccaggccgtcgttctaatgaatggatgtcgccttcgtccacggtataacctccccttcccgggatcaccacctcgctgacacttttgcatgtgcatgctaacgttctctaaacagcgccatcattcaattccttgcccctgattcttctcgacactctcctacaggtaacttcttaacatacgcaacgacttcagtgtattttgccatacccttgcctctctcatagcatgctgtctgagcagcactgtccaagctactcaagccggcgatcgctcctcgcatttatcgtagagtatgtttacgaatttttatttgtgaacaaataaaaaaaataaacgaagaggagcagaaaaaaatctaggcgaggcgagaagcaagtggaagaagttactcttgacctcgttgccaaacttcccgcagaacccggtatagcacccgcacgcggaatgcgtctaggagctcatcgctgtccaggctctcgatagactcgtcgaggtcgggatcgccttccctgatcaacaacacctcatctgcctcgtcgaccatgtattgtaggagatagccgatccgactggatagcgtgtagacgacgcaactgcgccctgtgatggctcttgaaccagtgctgtacatgtacatgctcccgtggtcgaagtatgagacgttgaatcgcccacccaaccagccattcaccctcgactcgtctacgccactgccatagcctatgcataaggccccgtccaggaacgtctcgaggtgcttccgcatctacgcctctaagcaaactcgagtctgctgcaagagggcatgcgcccgacactggcccgcgtacacttttcgcttgcagtgggtccttggagaggcatctgaagcccggcatctgtcagtgcagcggcgagccgctcgaaccactgcaccctgactgtcagcagttcccacgcgcgcaaaagtgcgcattaacgactatttgataattctgtactaacctcctccggatgctgctcgcggtacctcttgtccctcgcacgcatctatggacaaagattgcaaggagcagcaagttaaaccctgcagaactaatgacaaggagctagacaggcagctgtggtaggagcatgctttttgaaagaggaggatgcaaagagaacgactttgtagcccatacctgactgtgcaagccaaagatcacatccatcattcctcccctcaaaagccgtcagcgacaagttagggtgcatgaaggatcacgaaaaagcctgcagtaccgtcggtgccagacgtcagaacttcatcgctgcgaagatacagaaatggggatttagaaacgaagaataccacatcttcggtgccctcgtcaccgcccacacgcttggtatacattgtatttcaaacgatttatttttcgctctcttcaacatagtagtgtctatgcttgaatagtatgctctgtggtagagccttttagccctgcgaaaagtcttagaggtcgattggctgagttctgaagcaggcaatgtgtatgactacatgaaaaggcactgtcgagcgagaggcaagagggtgttggaaatggcagagaagaggcggcggtggtgagagaggcagcgaagcaaagagggatggaggttgaagtagacgagcagcatcagcagcagcatcagcagacgagagagtgtggccaccaagtcgcccgctttcagtcaattatggagggtttggtcaattatgcggggttcgtgagtaaacgtgacatagacttgcaaggaaatacagatatgagaggaagtaacgtaaagtggttcgtaggtactacagactaaagtcgggctttgaaaaacatctgtccaagacaggccggatggtttagtggtataattctcgcttagggtgcgagaggtcccgggttcaattcccggttcggcccttctctttttgcctttggtcgcgcatggtccatctcccgtcgtgcgctgcttctatctttttgctttttctctgtctctctcattcttttggcagtttattcggctccttcatggctcgccaaacgtgcagcgaagcaggcatccctcctttttgtttttaacgacgacagcatccagtagggaagagcggcgatcactttcggaaaaagatatctcgtggtgactctcttgctccaagattagctcaacagcccttccatcccatgtgtttggcagcaggaacggtcgatcggttcttgttgaggataccgtggtccgcgcgagagcggagctggcgtcacagaaacatagactttacaggcctacaacgcaaagtcgcactgttagttttgtacgtgctgtcgcgaaaccttacttcctgcactaagcgaggaatacctgtaatctccacgaagtggagggcctacgttgcatacgggcatcgctgccctttcgatgtcgtaggcagtaatcgactccagtcctgatgactggtgttattggtgattctcgatcgcatatctcgagaaggggcctagtctccggcgcgtgggggacctgagcgacggtgctccagctagagcgatcgcgagggctgcgtgggggtctcgcgccttaatggtgtacccaatttggaccgaggggcacgccctattagtgcactcgagggccccatgcactttgaccattttttcctggccatggatgatccgtcgccctctcgcctgcgcaaccggttcaaagcagtaacaacatgttttggatgttttgaactcgtccgtgagtacagccacacagtgcttcatgtgctcctgtcgcaactttttgcctccgcgtcgcgtgtgaccacctattcgcaagccaactcctgttccggcgtctcctattagcatgactggtagtatgtccgtggcctgtttgctgcactcgctcatgtgcacaaacatcttgtctttgggcctgttgggcgtatggtgcatgctgcagagtgcgcaccatccatcgacggccgagacgacagctgctggtgggtcaggcgagggcaggttggtgttggtgctggtcttagtgatgccggaggaatgggacgaacgcgctgtacagaaatgtaaaaaaaggagcaatttcagtttcatggcgaggagagcgtctatatgttgaagtgggaaccaatcgtccaagttgattaccatggtcttgagcctctttcagcacggcgtcctgaatatgtcgccgctcagcagatcccagcttttgccagcagcgttcggttcgtaatcgttgggtgtggatatccttgattctttgccgagaggtttcgaaaggtcgaacaatatcccgaatctcccgacgtgcagcgtgagcatcgctgatctcgttcaaagtagtagccaagaccattgaattctggctttgtgaaatggtctcgtacgctttcttgacagcctcatcccctttcagtcgcttttctcttctcctctgcatcctccgggaatgtgaaatgctattgatctgggctgcagtgattttgcttgattccggaacatgggagacacgtcggggtacttcgacagttggatcttggagcagacagaccaacacaattggcaaatcgacgtatcagtttcgactgcctgtatacacacaatgcacatcacgatagatgagaaaaggcaccttaccatgcgcttccttgaaatactgaaggtggtcttcaaggcgttgctgcgtcacgggtaccgtttcgctcatgttgactacaccgtagtctgtaccactgaacaccactgcccggttagactctcggctttccttcatgatggtctcgatgtccatgtggtctacatcgtcctccaccgccgggcaaagccaagttggggtcgttagctgggctgtgtgactggagaggcaaacatcctggctggactttccgatttgctcgagtttgttccatgtatagtattccttgcgcactcgatctagatcccgctccatcggtcttatctcatcttatacctccctgacaaccctgcgagcctcttgcagtgcgatgtacgctgacttggtgcctgtccggttcgagtctctgcgggccatcgtctgtgctgctcgtaaggttgctagccgcttccgaggtgcctttatttgggcctccagttgcttcttttggtttttaaagtcctccgccttgtcgccaattgctttcctgtccatgttcaatcctgctagaattcgcatccacttgctgtgaccgccggaagtacccctccgtgtcctttttctcttctccaaactacttgcgacgggatgaccatctctgcttggcccatgagggataactcttcccaggatacggacagtgtttcgatcaacgtaggagattctatgatcgagaacgacagagagagtgttaacgacttaatggaagacaatagtgcgggcttcaagtaaaaaaagcatattcactcacctgtctcgaaacacaaggccatgcttgacgcaaatctgctcgatcgttgccatgtcaaagatcgctccaaacacggcgcgcttattcagaggatcagccgttattgcctttgcgctggtcaaataagtcccgtgccggtccttgatgtcaaacaagccccctccacctgacaaaacctcgtagatgccaaccgccccaaggttcaaagcatggacagatccaacggagatatgcggggataggcgtctggtgaactcgctataccctgtgagtcgaaggacactattggcaatgaaggccagcggggcacggagagccacatgtggaatcgcgtctcgggtcttgccgtcatcggtggcgggtcgtcgcttgggcacgaacgggccaagaagcctgccaatcttgagaacgacatcacattcgtcatccccgaaatccgttcctcgaaatccttttttcctcacccaagcgcggtcaatcagttcgtcgcccgtgtcagattccaccaatgttcggagaacacactgcagcgccttaagtctggcactgctgggctcctttttggctactacagctgtagaatatcaatatctcgtgtcagcatcataactaacgtggcgtagtcaagatattctctctacaacattacctctcggctcgagcactgttgcttcaactccaaaaacagagtccctgtcttcgtcatcggagtcatatcctgtatcatctgtagtatgctcgtggacaccttgtggacacggtgcccctgtctgagtaacgtgctcttgcacctctcgaaccgcttggctttcctgactctccgctgcagacttgagagtctcttcgatagtgggaagtcttgtctgttcgccagccctgggcattcgtctctgatgctctgttattaacgccagcagaatgggcgcccgtctccgcacgacttcgtctctagccgactcgaaaacatctgatagctggtccatgagatccactgttttggatagccatcgtttgcgttgtgttctggatgtcgatgctgctgcctcacgggacttcttgttgtcgagggcttccttcttctcctttgcccttctatgctttagatctcgagttttttgttcccggagaggcgcaagatgtagtcggagaagtattcggagcaagtagtccaaggacttcttcttgatacttccttcccaaaggttgttgatggctgttgtgaattcgcgtaccgcctcgttaagagttgccgataatccttggagcttgacgcggccgaaagcaagggaagcttcaatagcagatgcgattcgctcccatagaggatgtttgtttttggcctcttgactggttcctctcggtcccagaaagcgagtgtgaaggtattgcaaaaagtcttgcgagagcaatccggccgcatcgaggagctcctggctgtccgtgttattgtcgatagcttgctcaagagaagcttgaaacatctctgggatcggtgccacatctatcctcgatgacattgcacatcgaggttggaaaccgcttggcagcagatccataatatcgagcgtcttgtctgctgtagcgagccactcctccccaaatgcatcaccagatgcaatctattcgaaacagattcataaaggccaagttattaggacgcggctttgttacagcaaagcctgaagcagcgatacagaccaaagagaatcacggttaacatacccgtaatacagccatgttggcaagagcggcgaggtcagcaatgtcatcagtaactaagagctgcttcttttccaaggcctccacaatgctgtccatatgctggactatgtcacgccgcacaacacttctcaatgtgaccgtgcaagtccgcaggttttccttctccttgtcgacctcctcttcaacgatatcctcaccctcctctgtccctgctgctggtgggccgcgccctgacccaaagggtttggatgacgatggctggttggacctggccgccttcagacccctctcgactttcaagagagccgcatcccacaatccatcgcattgcgtctcgactacctctcgccatatgctgatgttattgcttgtgtcggcaccttgtatgttcttaatagtaacagaagtgaaggagtccgccaaggagagctttgcccttagctccaacgcgcttttggacaatacatcccgcggaagccgcgttctgttcaactcggtgattttgagttcctcgccttgacttttccggaactgtgcctctgtctggcctggcaagggttttggtttcttgaccacatcgccggccttcttgtcggccatctcacgtagcatctggacgctattgatgatagtatgaccatgacgcgtatcagtggcatattcaagaaaattatggctgagttgtcatcaaagtcaatatcacttaccaggcctctctgatcgcttgtctgcattgttctcttgtgacattgtaagagggcttgacctgcgtcgtgtccgtcgttcccttgatggtggcgacgtcaacgctataagtcaatgtgggcgtgggttccacgctgatgcggctgacaggggggggtccgtgcctttgtcaacaccaagagctcgcttgtgccatgaaaggaatcgatgcgttgtagaaatccaacggtggctcgggggcgctcaacggcaaatacgtgcgtctttttcctcatcgagaagagtacgatcgttatctggaggctccttgcaaggtgccaaagcatcaatcgactgcgcgggggaatgacgatgctctgttctggacccagctccaagcgaaactcgaaaggggatggcttttcgtggtgggtgctccagttgagtattgtccgagctatgtactgggcgattccggaggaactgcaatctactaccagcccaagctctaggagacgcttcaaagttatacgtggtgactcgttgtgtgcaacggacaagggttgatcgcaagctgcctggagtcgccgagcgagttcctcgtcgtttgcgaaagcggggacggcattcatccactgcgcgtcactgaggatgctaggccgaaccaaagttagagaaggtgggtctggagggagcaaagatggagaaagcaaaggtggatgaagcaaaggtggagaaagcaaagatggaggaagcaaagatggaggaagcaaagatggaggaagcaaagctggaggaagcaaagctggaggaagcgggtccggaggaggcgggtctggaggaggcgggtctggagtgagggtcagcggagcaggtggaggggagtttagtctcgaggacgttctcagtctctttggctgtggctccatcgctgaactgatgtagcatcgcatcgagcaggagatggttagtaaagggtcgacgccaggaagctcttcggacaagccagcagtggcggtgtttaccttgtggttggtgcggctgtagaggatggagtggacggagaaggaaggaagagaaagcggaaagctacaaggacggtccgcttagaaagtatgcaatcaccaggtgtggaccgtttttttattggtggcgtggatctacagtgagcgccaaacgaggggaaaccgttaatataccagatgatctccagtcgataagccgatattcagggccagctgcaagtgccggtatatcaacctctgatcgcgtgctatgaatatagtttttcagcatgacaacagaataatgaagcactgatcctctgtgaattccttccctgttgtctgtcggtgaacgttgttgcgagctgaatggtgaccatgtggcaccaagagtcgatggctgcgtagattgtcttcagtcaccaatccggtttctagcattcccagcagacgatcttcctcttcttccattggaccatactcttgaagacgagacatcttataggaaggctagtgcgagttttggtgtcggacgaccgctggttattcatggccgccatcttgagggactcggcctggaaagcctcgagcatacgttgatattcataatcatccgctgcttcttcagcttcctcccagatcgcattctccttgcataatcgtagctggtctgccttttcctcacgcctctgccttttcacacgcctgttgtgcgctaaagtcaaggaaacatatgtgagcagccttttcaagtatgagcaccagtacgaatgacacctgcctcaatcctaccatgggcgctgcttattttcatgattgcgaattaatggccgggagtgacacttctagatgatagcctacgaagccaacggttgctcctggcttaagcaaagtggtgtctgcgaactagacctggggatgcgttttcgttgtttgctagaaaaaaagtgagattcaatgggtaatgcgaaatgaatattaacaatggacccatgagacaacggtgctgtgagaaaaatgctcacacttccactaagtaacccggggcttctcaggagagtgaggggatacctttttcgatgcgcttgctcattgttgagatggcatgaaatgaggcgatctttacagggatgtaactcagcaacgatgagagcgcgcactagcggtcacttccctctcttgtctcgctcccttctttcccaacgaccgtaactattgcctcattgccatgctccgaagactagaaaagaagcatctttcttccaacatgctggctcaatcacttcttcgatccactgcccgaatcacattctcaaaccacaatctgaaaagcatgtcatctctagcctttaacgcgaacggtcgactcaaggtgagcctttttctcattcgacgacaaagaaaagcaaaaaaagcaagagtgttgcactccgcactgacttgttcattctccacaatacagttgaaggatccctcgttgatgaggtcggccggcttcatcgataacgaatatgttgagagcgcacactctggaaagcacttccctatctacggtaagtggccattttacctaggtaacgcacgcatcgcatcttgcacacgttctgatcaacgttgcgttgactctgtaaagatcctgcgcgtggagtcgagattgcccagttccccgacatgggcacagaggagaccgaacgcgcgattcaagcagccaagcgtgctttgccggaatggagtcaaaagacagccaaggtatgggccagcttcctctgaccagagtctgcaccagtactccacagatcgtcttactgtttgtttgtgctctctcgaatcacgcccgagtaggaaaggagcgccattcttcgcacctggtacaacttgattctggagaatgaagacgatttggccaggatcctcacttgggagaatgggaaaccacttgcagatgccctcggcgaaatccgatatgggtaagtgtttggttcgaagccgaatgatcgtcatactctctaaaccgctagtatctgacttctgttcatgtctttacttgtgtgcccgattagagcaagctttttcgaatggttctccgaggaagccaagagggtttacggcgaggtcattccaagcccgagccgacagcagcgaatgatcgcgatcagacagccgctcggtgtggtcggcattattacaccctggagtaagttggataccacggtgttcttttcataaacattacacaaacatttacatccatctcaccaacaacacgcccccttgcctctgtagatttccctaatgccatgctgacacgcaagtttggagccgcgctggctgtcggatgcacagtcgtagccaaacctgcttccgaaacacccctctctgccctcgctctttgcgagctggggaagagagcaggcgtgccaaagggcgttgtcggtgtcgtgaccagccacagtaacacaaaggcgatcgggaagcacctctgcgagagcttggacgtctcggggatctcgtttacaggttcaacagcggtcggcaagatgttgttaaagcaaggcgcggacacagtcaagaaggtgtcgctcgagcttggaggcaatgctgcctttatcgtttttgaagacgcagacattgacaaggccgttgatggtaacggaaccaccttcacactgtgttctcttgagtatccagttcggacgcgctgacaaatttccttctttcccctctctaccatgctagccgctgtcctggcaaagttcaggtcaagcggtcagacctgcatctgcgtgaatcgattctacgtgcactcgtcagtcaaggaccagttcagcagtcgccttcgtgagaaggttgcgcagttccatgtgggctcgggctttgaaaaatcgaccacgcatgggcctctgatcaatcccggagctgttgagaaggtccggtcccatgtgcaagacgccttggaacatggagcaacacttttgcatgggggagaaaaggatcagaaggacctgacacctgctgatggatacttttacccacctaccatcttgactggtatgaagaacgagatgaagatggctagcgaggagacgttcggtcctgtggcaggaatcttcacgttcgacacagaggaagaagttttggaggcagccaacaacactcgatttggcctttctggctactttttcagccaggatatctccaggtgctggagggtagccgaaaagctgcaggtcgggatggtgggtgtgaacactggggcaatctcctcagaggttgcgcctttcggaggggtaagtgtcttgctgcattaccttgctttcgtgtttgctcgtatgccatcatgaacatcacttttcagctactcctagaagattcttaaccactggtatcattctctcgggtatggcatgcatctgtaggtcaaggagtcggggatgggtcgcgagggtgcgagacaaggtctcgacgagtacacgcagtacaagtacatcaatatgggagtgtgatgaacagccagtagcctcttcatgagaggaataaaagagataaggcagacgcctgaatgtccactgagagcggccaagctggcgcggcgagtgcaacgctttgccacagtgagtcactgggcagcaagtcgcgagaattatggttcaagacaacggctcgctcgcatataaagcaccaattcagccgcctcttcaggatcagcttctaatcctgatcagcatcattcacttgcacctcgctcttgcaaactctacctacattacatctcattcacctgccgaacatgagctacaccatccgctttgtagagaatccagaggacatggctagatgccatgaaggtgtgaaggatgagaagatctggattctttaaaaaaaaaaaaacgctcaccgcagtagtgcgagttgctggttgctaacactttcatgcaacttttcctagtccgcttcaaggtgttttcagacgagcaaggctatgaccgatctgtggaggtggacgagtaagtaaagccaactggctgacaatagaccagcgtcatgctcttctgattcaacgcacgaacaccatatgactgcggtagcttctttgtagcttctttctcacacagtcgcacggttttgagtagaatcgatccagaatgtctgcactgggtcgcagttgatcaaaacgggcagggtgtcgggactttgcgtctgtacaagtattcggccacagttgggaaggtgggccgtgttgctgtcctgttgaacacgcgcgggagtgggctcggcaggctgctgatggaggccatggaaaagtgggtgatcgagaacacgcagttcgagaagctggcgctctctagccaggttcccagagccggcttttatgaaaagtttgggtatgttcgtcaaggcgaggagtatccagacgaggggcaaccacacatctatatggagaagaccttggccagatgaataaaatagaataatgctggagcagatcagcgtgagctggggatgaccattcggcagttacaacagcttcgtctctcgctcgctcgctcctgctctctgtgctgccgaaagtgacgaacgttctcggattactgcgtccgtgcaagaacacggacatgggcgtcgtgagcgagggaggttcgatcctgaccccgaacttgatcctcaccatcactctgatactggaatggcgtctgtgccgcccacccacccatgctcaatccatccctcttgcgtgtcgctgcttcttgcgatataaacgcccagccactctgatttctgcgtttgatagccttttcgtttctttttttcttttccctcctcccttccagacgtttacttcacgcctcgaacacatcctgcttccgctccgggagcacctgtgaggatgtagattgccctgtctgctgctttcattcacgacctcaagtaccacattctcaagctccaaccaccacaagaacactgacctgacagcaacttgcctgaacaactctctatttttccaacggatgcgcgctttttcttcacgcccttctcaaaacacgtcggcaacatagagaatgtcctctcatcaaaacagagacgttttcaatagcgaccttagccccgcctcaacaccctcttcggccaactcgttttctcttcccgtctctgacccagctgcaggccaaagaccaacaccgtcgcagtgtcatcagctccacccggcaacagacctttcggcacagtcttcatcctctttttcaaggactgtggtcccacagacaccatgcagtagtgacttgagcaatacttctgttgtcggagaggttaggacctcgtttggcgtaggcgacggggactcgcggtggaatgcagagggtacgttttgttttggcgttgctgcgtttatgcatgcgtctacgcacatccctcttcgtggacgcgttctctattccttcctgctcagatgttgaatagaggaagaggaggaggaacgatagcgcgcctgctgatcttgtccttcattatatttgtctaccttctgtctgtctccgtccccgatccaaacactctctttagcggctcagctcccaaagccaggagaaagcccatacgaaggggaatcctcaaacactagctttccacgccctcccctccgccttgatgacgacggcagttctgccttccaaccaaagctgggcacacaggatgtggatatgcttggtaccatacatcgggactaccaggacgattcacagcgcatccaccacatagcattttatcaaagagacgattcgacggcactctcttctgctcctctgcatgcccttgacacatcctcgcctagcttcagcaatatcgattcttcaccacctctgcacccttttttaaggtcgccatcgtcaccgtggtctcgcagcccggccctctcaaatcgatcatcggcagccagtgtgtcttcaccactctcaaggtcaatttcggcattctcctcctcctcaagacccgtggagccaaggcgaccacggcgtgttggatatgattttacagaaggacatggtgacatccagaaagacagcatcacgagggacggcatggcctacttcacctccttgcatcctcttgagcgatcctcaacattttcacactcgtctcaggagcatcaaagtcctgcacaaggataccggtcgcctcatctggcgctatcgagtggtgatctttttgagggtgacgtcagtaccgtctacccgccgcccatagaagacgctaatggccatccttcaagcgcgctaggtcaggatgaagattcacgcaccgcgaaagggcgagagaggcggccgcctttttacattggagaaagcaattccgaagtctcgcagccttcgtcagcctctgcagcctgtcgagatcagattgaaattgaaatcaatacgccgttggggtcacggaaaagagcaagcgaagttggtaagtggatggtggatgaagcaatgcgccttagagtgtttgatgcttctcattctcaacgagcttcctttgcaaaactgtagacgaccaccacgacgacgacgacatcatgatactaccgagtcgacctgacgacatccacaacacgcgtcaaagtttgaacgatgaggaggagagcgacatcaagcgatatgcaggactaatgatgaaaacggccactcagacaacttcacgcacgcctgaaggcacaattgtaggagcaggacaccgacctaacagcgatccaaggcaggccaattcctcctccaaggtcatggacatgccatttgatgaggctgcacggtccggagaggctggggattcatatgaaggcaaggaaagtgaagcggtccgacaacaagatcaggcagagtccccagtcagaaaactgctcaggttcagctctatcaaaagcaacattatcagtcgtatttttgggtctcagtctactacatcagcgggtagcctgtcaggatcagacaacgacaacagtcgcgcggcggaaagagatgatcgggcagatgagatcaagcgcatgagcacgggcgctttatctacaaaccccatcagctcagggtcggcactgaatccgaatcgtagcgcgcacaacagcaccgcgcatagtggccaactgccccgatctggaggcatcctttccaaccttctcaaaatacaggccctatccatgcccccttcgtcatcgcgacgccagaggaaacgtcgctccagccatcatcatcgtcaggatcatcgacggcagaagaatgctcgcaaggcttctgttgcgtccgaggctccaccaagaagcacgagtcgttatttgttgtctagtccgagcgccagtgtcctctctcttccggggatgatcatggcagcaccctctggtgtaggattggcacccaatggagcagcctcatcgtcaacgacggtctacccagatgaccctcgtccagctgcgacggggaggaagccccaacacatttcgacgtctgtaggcggcccacacagaacaaaatcgggcgatgattcttcaatcaacaccacacccacaacacccgatggaacgtcactggcgcctcaccgacttgggacgatgaccccaaagtacctccggacgccctcttctcggagtagtatctctgcagatgacagcacgtcaatctactcggggatatcacaggatccactggtggcggcttatcgactgaaccagcaagtccagctcacggaagctgtggccgacattcttcagtgtcaggatcttctgatccgactttgcaagagttttattcgatatggcgcgccttcgcatcggattgagctggctatggaggccatgtgcaagacgtttggagtggatggctcgtttgctttcttgcccggattaatgatgatctcgtttggagattccgatacccacaccagcgagacgcacctcatcaagtgtgcgcagggatttgatatgggccggctcgccaaagtccacaagattgcacgcgcagtggtgtacaagcacatgcagccagaggaagcccttgcgaatctgaaggagatcaatggagagaagcaaccttataatatgtgggccatgctggcagcttatgcagtctcgagtggtctcatcgcaccgctggtcttcaagggtagctggtatgacatgttggctggcatgggccttggatccgtcgtcgggctgacgacactgctggccagtcgctactctgtgtactcgaacgtctttgaggtcagcactagcatcgtcattgcattcgtggccaaggcattgcgggactatgtttgcttcacgggtgtggtcttgagcgggattgtgatgcttcttccggggttgtcgctcacaaccgcgatcatggaactctcgtcgcgctacatgatctcggggtctgtgcggatgttttattctctgatatactgcctcttccttggatttgggctctcgattgggtcaaacctgtgggatgtgttcaaggcgcctgcaccgggtgacccgcagagcggattctgtcgcccagcaacggagccatggcggtggattctatttccgttcttggcgattgcgttcaatgttcagctgcatgcgctgccgaagcagtggcccgtgatggtgatctgcagctctgtcgggtatgcggtcagcgagtttgcgggactgtactggccacatgcgttgcacattgcagccgctgtgagcgcgtttgtggttgggcttctcggtaacatttatgagcgactcactcacgaactcggtaaggattactcctcttttctgttatggctcaaggaagagtcctgcacctgcactgacgccattgctgtgcctcttcaaattactgtagccttcgtcccgatccttggagcgatcttgctgatcgtgcctggaggaatgggtgtgcggtcgtcgctcctgctgctgggtcaagccggcaatgcatcccaaggcactgcctttgcgttgcagatgatcctggtcgctctcgggattgcggttgggctctttgcttcgactctggtcgtatacccacgtaagtttctatgcgcaagtgcgcgactatcgtggcttttttctgtcacatcgatgctttgaaacgaagattgggcggctaagcaactttgtctgtctcgttgtactttttgctcgcacctagttggaaagaaacgaaatgcgctgctgacgttttagagtgtattatccaatagtaatgtaatgtagtattgatggtcactgcccctgactggccctgaaccgcatgtatttccggttgcactttcatttcacaccttctttttgcgctttctgctgtcctgttgtttttcaggtcgctgttgtcttttgtatcaagaccttctgtgtcgcaccgtgctccattctgccttgattccttcgctgcccattcactctttcggtcccttgttcgccgtcattctccctctccgtcgtttgcagttcactttcacagtcctcagcatcaatagcattcagcctgctcagtggcaattcagggacactctagacacgcttcaggcaccagagatcattcttcgctatagcccattggactgagctcccccctttggtcttcgtcatcgctcacgcattcaggttttcgccactcacgcatttagttccatgggaccaaatgacccttcacctgctcgccaggacttggactcagctgcgggtctctctcgagtgtctgtacgaccgccctctttagcccacagtcatgcagcagcacagcccgctccgccaccagcaggatcctcgtggccgcgtgcctcaacgcattttcctcagcaaagccttggaccagggtccaacggcccggatatcgacagccgtgagggaagcattgacaactcgccgaccctcacctggtcgcagcgactaaataatatggcttacaatcggaccgcccagtcgcaaggttttatttgggactcgctcgacaacaggtcagaacccctgaacctttacgttttttttttttttttttttttttttttgccctaccacattgaaaagagacgagagagtttttttttttgcccagcatgctaactcttagctcggttcgcttgattagcctggaagaggttcaagaggccaggaggattcgcaagaaaggtcccatccggttgctcacgagtcgcaaggacacgtcatataacagcatccgctctacttttcgactgcagtatgctgaaaagaggtatgaggactgaccttcacaacggttgcacagtaccgagaaatcgctacccaaagacgcaagtttgccccccccccccttcttttttctgcatgcactgttacttcccacgcgcactctgtcatctgatatctcattgcgtttgctgtggtgcgtattaggaaaagcgaccttcggaactttgtttcctcgatccgtttgggcctggattacgacgtccacaaggcgcgggccatggcgctactcaattcgaaggcccgcattatttttttcgtaagagatttcgctcgagacaggtagagggggccaagacaccttccatttgttctactgactcagtggtacattggctcattgcacatagattatgatggatctggcggtcgacgcgctgttctgtattctgtacctcgtcgaggcccaatacctagcccacaaggactccaccccataccctaatccgaagtggctctttgtccctcggcctaaagggatctgggtggctgctgtagccatgagtagctggaatttgatgtcggctttgatccgcttcatgtttgccgacaacaggtacagtctgcacaagttgtgcccagtcccgctttgatgaagtcaggcacattttatttagaatcttgatactggaccccgtccaggtttcactctattttgattgctgacaactctgttttattttttcccttgcaggtggagattcatcttctcgatacaaactttattggacacagtgaccgccataccgttcatcctttcgggcgctttcctaccaagcggacagtggatttacgtgccctatttcctcaggagctggagtgttatttctcgacttcaacgagcgctgagtataggcgtcgatatcgggatctcaggtaaagggacaattctcgttcttcgtcgtgttctgagccgtcgattgctccatatctggatcagctcaaacatctggaccgtctcgaagaagaaaaaaaaacacacgtctctgacttacatcaaacaatatgatatagaccaaccgtttgacccagtcaaggcgaaactgattgctctggtcgcgtactttgtcacgattctctacaatggaatggcggcatttttatactgcgaaaccatgttcgcacccgctactgaaacacctcattcagtttgggatgcgttctattttattctgatcacggcctcaacggttggatacggcgacatcacaccaaagtcactggagagcaggatcgtggtcatggtcttcattatcgtcgcgctctctgtggttccaggacttattgcgggcacgattgagaccttgaagtcctctcggtccggaggtgggtcgtacattcagagcaggggggccaatggcatggcgaagcagtatctggtcatgattggcaactttcagagcgccaaacgtgtcgctgatatgctgagcggtttcttcaacaaggtatgtaacggagggcgatccgtagtgatcctgtctcgaacatgaacgcgaacactaacttgttagaggtttcttggtgccttattatgcatgctaggaattttcggatagcgatgtaagggttgtctttctttcgcgcaacaaaccctccaaggatgtcaaaacactcttggatatgccaatgcacaagaacaggacgaccatgcttgtgggcaacggactggacgaagtcgatctgaagaggtgtcaggcacgcgatgctggcggggtcttcatcattcctggtaagtcattttgtgtcactctggtggcacagctagcaccgggtcataatcaatgctatttacgaactctgaacactgacatgaactgcaaaacacacactctagaactaacggcctcaggtttggaatcgcaggacaccatgacgactctcctggcatggtcgctccacatttatgcgcccaacacacgcgtcttcacgttcaatcttttgccagagaccgagagctttcaatggggcattgtggagcagtcaatgtgcatcagcgacgtcaaacaactcttgctcgcctacaattgtcgacatcgcggcacagcgaccctgatcctcaaccttttgcacccttccgaacccgccaacagctacgacgatggttggcaagcccaatatggcgacggaacaggcaatgagatttatgtcggacttgttccagacgtctttattggctggacgtttgctcaggcggcctggttcatctttcaagagttccagtcgatattgattggcgtcgacatttttttgaaaagcgatccatccttaggagacatggacccgtcggatggtcctcactgccatgaccctagcaacatgcgccaaagacggcggtcattttcaaccaaatcccatggacaagaggccccctgtgctgaaggacaataccacttgacgctcaatccaggaaacagctaccgcctcggacggcatgaccaactgatctacattgcccagtcgcccagtgacatcgaggcgatcggtaaactgaccgcggagcagtacgagcgactcttgcgggacgaaaagggtcatcttgataactctcgcttggactttgcaaaggccatgcacatgtatcactcgctgcgggactctcgagcagatgcgcgagcggccgcgaggagcagagcggcccatcgaaaaggaaagaaagtgcgaacccagaaggcatcgtcccaaacaaagtcggggtatgagaccctcacacccgagctcgcgtccgcagacgagatggtccaggaattcgttccgcccacccaaggtgggtcattggtggaggacaggaacacccggtcaaggaagactgccagcaagatctcgcgcccagcctggaatgtggcactctatgacgacgacgatgacgacgaagatgaagacgatggcgatgaatacgaaatcgatctcttgaaagacggtcgtagcagtctggatcgggtcagaagctaccagggcactgtcagtcatcggagccagcaggaacctggtgcaaatcaaggcatggctcaggagtacgggatgcaggatcaggaaaccatcccgctttcggaaccacggttctggtccaacaaagaaaacaacggcagtgcacaggagcagatggattcggtggggctcattcatccagaattttacccgtccaacttcgatagaaatgcggccgctgcagccgctgcggacgcagctttgatccagcggcagaggtcgggacaacaggccaaggagctctcctcgagtggaccaaaggactcagccagcaaggatcacaaacgcatctcggctggaggtgctgcagcagtctctagagttgctgtctccgcgtttctgaagggaaagggaggcgagaatgccaggcaaggaaaggaacctttaacaaatgaattatcaggaacagcagctgccacagaagcggcagcactcaaaccatcccgccctcgattggctatgcatggttgcagcagctgcacctctgtcaagggctccttccaggctcttgatgggtcgacgtacgtgggtcagacctctattacccgatcagagaccaaggacctgccactctgtcatctgctgatcaacccaccagagacgatcaagccattgattcgggacgatctctccagtctcaagaaccacatcgttgtctgcgcaaacgccggggagagcctctacaggttcctggcgacattgaggttggcgcagatcaagcgagacgatctgaagacgatcgttgtgctgacaaagaaccctctcgagaccttcacaaccgctagcagtgtcctgggcgagacaggtgaacgtcgagagggagcgggccttggtcttggagtgaatgatcatgttgatgatgtcggcgtggacgagagatatggcacaagcaactgggacgcggtgttgtcctttccacgcgtcttttgggtgtctgtgagtgcttttatttgtttctttctctgtcagctagggttaaaaaaacctcccatgcttgccgtgttcgttggactgaacgctcgttatgtatcctcttttctagggcaattgtcggcatcaacgcgacctcgtcagggcagggattcttggggcgtccagcattgtcgttatggcgcactcgttcgctggcctagaccgcgatgagtttgcggacagcactgccatcatggctcaccatatgatctaccaaacgctacagcagcgtggcctcttgggccgacaacacattattgtcgacatctgtaagtcccgaagagcgaacgaccaattgcaaactgtacttttaaaggacgtaagaggaagaaaaagagagaacactgtgctgaattctcttttgtgctcttttggtttctgttgcctacgattagccgagagaagcaacattcggttcctgaacatgatgaacctcaacatgatcggatccaatcaagaggtcatctccaaggtcagccgcataggtacagggtctgccagcagcatgacaggcgggttctggatgacgcctatctttgccagtggacaggtcctggtcagcagtctgctcgacaatgtcctcttccaagcctactccaagacccatatcctggacctcatcaagttgtgctgcggcgtgcgcttcaaacaggcgatcgagctcgaccaactcctaggcatcgactcgtccaacctctgcctcatcgaaacccccgctcagttcgtggtaagaacactttctctgcttcgcctacgttttttcgcaaaaaaaaaggcgcctatttttttctttgcgcacaattgactgatatcgcggtcccttttctagggcaagccgttcctaaaactgttccaaacactagcgctggtgtatggtattgtcccacttggcctttaccgagcgcccgaccgcgagctgaacaacgcacttccgtttgtgttcagtaacccgctgccaggaattctgctcaagagcactgatatggtctatgttctcaagtcctgagaatcctcactgttccctaccccaccgtctgtagcctagaaccacggtcgtgcacttgatagaattgtaacatagagtcactatttgtgtttattcatgagggcgagtcgatgttgatggtatatgatgactgttcgtttgggacaaagtttgtgctggagattggtcctatgttacagtgatttcaatgtggcagggtcgagagaatccaagcgactgactcagacctgttcgctccttcgtcctcgggttccgttctcgccttcatcttcagactggtccatcccgaagcgtcgcatggttgacgaagaagatttgttttgctgttgcaactctcgattttgctcttggtgctgacgctgctgatcttgttccttctgaaggtaattgatcctgcttttcttcctttgccggcgttcctctgcaatgcgatcccattcctctccttcctgtgtgggcgggaacgttgtgtcccaaaaccctggaggagtcagtggcacctcgtgttggacgcggtgtctggaagtggcctggattcgctgctgcagcctttcctcccgagtcatgtcccagacctctttctccccaggacgcggagctggtgtaaagaatgtattgtagccgtctggcagaggcagagggcctgtcagctcgtaaaactgaaaaaggagaaacaagagagaattttgccgagcgatgaaaccagtcagtagttacctcgacgggtagagggaccagaaaccttcgcccccccccatatcacaaggagagtggatattggaaaacaagccaaatgtgtagacgtacccgacgacaacatgcacagtcatggccatgcatctgacgacgcttgtccttgcgacgttctgtgaaattatagatccgttcctcagctccctcagccatcccgggctctggttgttgctgcagacgtcgctgtgctggtgaagggggtgacacaccgtgttcctgctgcgcctgctgatatctagctgtatccatgacctcctcatgcgagtgctcgtcactgtccaattcaatgagtgcctcaggtccacgcgtccgcttcgggacccaattctccttgtcgggctcatcctcaaagctctgtgcctctgtctgatattcctcgtccggcaggtctattaccatagtatctgcagtgtgctggtcgggctggcgagatgcagtggcgactgctgggctagtggtaacggcttgcggattttggctgttcttcttttgcggcgtgattccctgcagttccagtggcgtctctggaacaaagactctgttcggctggtctggagtcacctttgcgcggttgactgtacggggcgcaacatcatttcctctcccactcccactttctcctgcacccgaggcctcatcgtgccgcaggccttgtgctccctttggtgttcgcggaagattggacggaagttgactggaggtcgttttgtgaatatctgtagacactgcgtccccggtcgacgctgaaggtcccgaagcgcgtgcagctccatttccttgcggtggtacctgttgctggtccttttttggcacagcgcacgacctgcttgaattggccaacaagtagtctgtagactcgaacatgggcggcgatgaccggtccgactcgatggtgggcatatccattcgaggcttaatacacttcgcagcagtcgcgacctcctgttgttgctggtgttgttgttctgagcggtctccgtatgttggcctcttgagctttctagtttcataagcacgggccgttggcgagacgctcttgaacgtgctagttttagctcgagcgccgcgggctgtaaacggttgatcatccccatggctttcgtcgccttcttcatcctcgccctctgaaatacagagtcgtcggcggattgccagatctgatggaaacgtgagtgacattggctgcgatccatactcttggttcgatggctcctcgtcgctcattccgtcccggcccgtcaaatgtgatttatacatcctatgctgtcctcgattgccgtcctcgtcgtcacttgaggtatcccccaagagttcatgcggttgagcggctgatccgacgcccagtggacgctgtatagatgctgactgaactgagtccattgatcctgaaggatatccagagttgaattggttcaagagagtgtttttctgagtggcctccatccgcagccggtactcgtcgctcaccgtgctgctgaacctggtccgcttcttgggttctgcattttgtgactggacagggttcaaggacatggcgcgtgagtccgctggggtcatggccgcctgtagccgacgctgatattgctggcgaaggaccttctgcctccactgggcccatttggcgctaatcgtctccatcatgattgacttctgctcataacgcagttcctggactgtgagccggttctccgcataatcacaccgcgccctccaagccttgagctctgcctggcatccactggaggcgcatgtcgtcgactttgctgccgggtttttgagagcagatcgaggtacttttgggactgaagaagacgagtcctggcctacggcatcctcagcttggatggaataggtccctttgctcagctgagggagattgggttcacgtttaccgtcttttggagatctaatgaaagtagcgatgggcgagtggcggttagaagagatcttcaacgtgcagtgcagtctacctaaaaaaaaaaatcatggatcagcaaaacctacacatcgtccaggatctgtgtgatggattgactgacgaacgtgttaaaagccgagggatcgtccatagtgccttcaacagtgccggttcggtctacggtctttcctgatagtttggtggtgtcggtgctcttgttgtccttgtgcatcgcctgtgagagtcggagctcgagttctcgaagtcgcagtgccatcaagctgcggtcctgttcgtacatctttgccatatgacaccaatctacggcactttttcggctctgcctattgtattccaaaagtgccttgttttcctgctccagggctaggatggagaattcaggcaaggcaccgtctgaacgtcaatgcaaggcgctcgagtctggaagcagcaaagagttttcctccactgctgatcgaagatgggcaggaaagacataagtaccttcactccgctgcagcaattcttgaccggctttggcggccagcgcgagatgttcctgaagactggtctgggaggctacgaccgaagccaagtcgctcccggcgggccgagccaaacgcctgccatgactggacgtggaagcgacagctggcggaagagatgctccagctgcagctgtgatggagacaacatccctgtcggcgtcagtttgctgattcgtagctactgactgtcgtggtcgctggcgtgcgggagctttagcgttgtctaatctaggggtggtttcgtgcggagggatgtcctgaaagggatctggctgtgcgtcggctgctccagggagagaatctcgtggccgcattggctgaggaggggcgcgtggcacgaaggatgagagggacgggatggatggacagagagaaagcgatgcgccgttcgtgttgtggtcgagtcaaagttaaaaaaaaacgcactgcccaggggtggctggcttggctggtcggttggtggcgaacgaatttgccacttcagtctcacctccacagtttgcgaagacatgagtgcgttttgtgccaaaaaaaaaacttcgcgtttttttttattgtatcttcgtcgtgtcgatcatttcaagctggctgcattgagcagacaacagaagacaaaaaaagaaagattttttgacaaaagcaactgtccttgttgcttgtcattccacaccagaaggtctctagcattcactctcctaaaaatgaagcgaaacctcctgctcggtcgtggtgtagagaatctcgctcttgcggaatccgttgaactgactggcggccgtgatcgtgtaagcacccatgttctcgaaatacagccagtcgccagcctccatcaggggcaggcttgccttgggcgagatgcaatcaatgctgtcgcaagtaggaccccaaacggaggctaatccgagagggtccatggtctcctgctgataagcgtattcgccggccttgagcaaaacctggggctcgcagacctggtggtcaaacataatgcagttgaacgatccgtacatgccgtcgttgatgtagtacatgtgcgaggggttctggctctgctccgacgtcaagacctccgaaagatcacgcgcgatggtgcggcgggcaatgacctgcgtcgccagcgtgaaggccgatccgacatagtagcgaccgggctcagcaatcacacgcacctcgggtccgaacagagcgtccacggtcgatcccagaatggcggccaccttctcgaatgtgatcccttcagtcacatgagccgatgggaaaccaccaccaacatccaaaaagttgaatgtgaagccatagtccttggcctgatcaaacacgcgacgggcacggatgacagcctcgccgaaggcattggcgtcgaaacatccgcttccgacgtggaagctgactccaatgacatccagtcccaattcctgagcagtagccagcaagtaagcagtggtgtccaggggggcgccaaacttgagtcccagtttgcacagcgacttggagtcatcggtcaagatgcggaggacgagctgagcctcgggatggaagcgcttgatcttgtgcaactcctcagcgttgtcgaaggtcatcatacgcaccttgttttggtacgcatacttgacaaacgagttctgcttgcaggggttggcatagatgatgcgcgaggggttgatgcccatctctagcacagattgaatctcgttcttggaggcacaatcaaaaccggctccaagggaggcgaggaggcgcatgaccatggggtcagggttgcacttcatggctatcgtacacaacaagagagcaaagagtcggttattaactgagatctgcaagcagcgggtctccagatcggaggtggagtgtagcaactgcgacaaaaattaaaggccccatatcgcggacgggaaaacaaacaaaaaagtagtccagttccggacagatccgtcaaggaactagttgaaaagttttgtacgtgggagcagtatcatatagcatcttcaacttaccaaagaaaggctcgatacggggcaagagagccttccagcgcaagtgctggcggtagacctcaccgagatcggccacgtaaaacgcattctcggcctcaacatcgtcgctctcgggatcaaaggaggcaagacgtgcctggagcatatgatcgatagacagggtctggacctggggcaactgagcctccttggccatgtcagccttgacgcgagacttcaagacctcgaccaaggtaggctgcaccaaagtgggcacgacctcgaactggtcctgctggtgagaaatatcgatcatcgttggagtggggggtgttaagaaagtaggtgatttgtaggaggggaaggaggaggcctggatagggcggatgagcggcaaggtcggtatgcgaaacgctagactagctatgcttttggggtgaactctctcagcaaggcctggacagggctgtgagaagagttgaagggaaggagagtggacacaaagaagggacgagcggcgagactaaagacggaagtaaagcttcccaataggtgtgcaagacagaaataggaagtggaaaactagacgttttttggaaaggtgtgcctgaagactatagagtaattcagacaagaccttgggattcgggaagccagggaggcgaacgccgaaagagaatggaccggatgttactgtttcttagcgccgtgatgttaatagcaaaccgaaaggggacggtctgcctggagggaaatgggttgaagcccgggggttctcttttaagggagaaaaggggggttgggggtgtgtttttaagaaaaaacgaaaagagaagagaggcaactgtaaggttgtgctctgttcagcagatttgggatggagaagtgggaaactgactagacaaagtgacagttgtgttggctgaggatccttggttgaggatgctgaggatggtgtttttggttttttttaaaaaaaaaagaaaggtgtggacgataactgcagctggctgggcttggctgtgggtacttgggaagggtgatgctggtgaaggctgaaagggctggtggggagatgatgaacagaaaggaactgtgaggaggaagaaagaaggaaaaaaaagggaggaaaaaggcgaaaaagtgcgtaaacgcctatttatgcgggcctgatggtgcagcgcattgtcagctgtcggtcagagcacgagcgaggcccatgttgttcctattcttctgccgggttgtgttgatttgttatgaagattctgaaccccgcacgacacaaccaccctcctgcgcgcatttctcgccattccacaaccactgtcatacgtgaaagaccctcaagggactttgaaaaatagatagaccagcagggacagataacccttttttctctgtttgcgttggccctatccacgtacgacgttgtagcgactcaattgagccgtggagtcaacgaaatacaacaaccatgggctcgcaatgagcggataggcgtgttctctggttggtccagcttccagaaaaaagatgcgacggatgcccatgaggcaattcttcccagatgccacggcgttccatcggcacccttgcggcatcttgccacaagcccatatctgcttatcggaggaccatttttgatctgcccacgcttttctcccacgcgcgttgcttcttatagagtgggatctgggtaaaagcgtagcaaagtatcgcatcacactgaagcacatagtacagtaggaaaactgacaacatgtgcacgccatgaggctcacgcgcgcgctcaattccaactccagaccctccgtcctcgctacagtgctcgttgctctttttttttttttttgtttgtgttgcttggttttttttcaaacctgaccctgagaagcacctgcattctcttgtggactctgcggtcctctgtcggattccacacaaggttttttttggacttcattgttattaaaaattcgtggattcaaaccagtcctgagccatattttgccaggctgtaaaaaaaaacgatatttaaaaatctcacctcagttttcgcatcccgcagcgacgaaggggcattcatgcctcaaaaaactctatcgatcagtctcaacttatataccatcggcatacttgcaggcattggaaggagaaaaatgaggcgacagactttctttcccttgcctacgcgccctgcgatatgtatcagagacattcagcaagcgactgagcgtccctgccgtccttgaggcatttttctcttttctgtagccacgacccatcggtctgggcttcagtgctagactacagcaacactagcctatacccgatgtggtttttattctcaacatctgatagtgtatgatgtgctgctcggcgatgagccccacagggcgagtagtgttcccatcaggtccgctttcatgttcattatcagatccttcccatctttcccgcacgaacgtctcctttcctacattatccctttttgtttaatcgcgtacctctcgtggtcgtaaagtgtttctctctctcttgtacctcatttcgtcgcccatgcagagatcttgctttagtccttgaacgcgtgcaatttactcgtgcaaaaaaaacaagatgtctctgcagtcctgcatcattttgacgcgtccacgcctaaagacgcatatggaaaatcgcgcgatgagctcgaggaaactgcacgtcagatccgtatgcacgtttgttgaacgcgcgcgctaatgctcattattgatttcaagtaacaccctctagaatcggttagtgtgcatttcggcccttgaaagattagatccagagccatatgtatttcatagatatcttgttcgctctcaccactcaagcaaaatcgtcagcgcgttgcccagagtcatcacggctaacgaacgcaagtactgctggctcatcagaatcgaattcacgtttgtaaacaccgagacaggcaagcccagagcatcagaacatatcggcgctgcagcctacccaagacacccgcgaccaattgcacgtctttgaaaagtattacatacagggtggctatcatgacaagcagtcttggtgagtgtcagacaaggtgcctccattatgggccactatggggagacgatcaacgtgtcaatggtgtaagatgaatgttacaatgatcagcatcagcaacgcaaagtcacggcaggctgcaaaagcggacatggcttcgaccaattccctgcacgtccgttgcaaccatgtgcaaaaaactatgaggagtcaactgcacacactacagctcgcttctcagcacagtgattccgcgcacgaactgctgagtcttggctcacggatcctttgctgatcgtgttatgccgagcataggcgtctacgcaaacgtctgatacgtcaataggaaagagctcagagagagaaatctcagacctgacacactgcaggcatcacaaaccactccttccaactcagagcgggacgcatgtactcgatcgcgatagtgttttaggtgataccgtcccgccaaacattcaacgctagtgccatcccgagtatgagacacctggcaacgaaaaccccgatagtatgattcgcggcgatattccagcaaaaggtacacacagaagcgcactctacccgtcttaagtgcattactttattgagccgtactactgtatgacctgacacctttccaaggcccatatggcccatgctaactatatacttagcgctacccggtgcctcttggccgataagggtcgattcgtacaaatgatcgtcgactagtgcgaggatggtcctgatgcgctaccaccggtatggttaagctctcctgagcgagggcttttgaccgagctgcttgaatcgcaaatataatacgtttcgacattcggcaacattcggactggtcgagcgcgcttctgttaaaaaagatcgtgtcgaatctgcaactcggatgatcaagatgagcaaccgtcgaaaacagtgcctcacgcgaatggcacactcgcaaagcctgtgaaaaatgattagagtaaacattctcaaaaaactgcattagcaaactcgcttgcgaaagacacgcataggtgtcctactatatgcgagagagcttttcaagctctaggacttgcgatggctacctggcgccttatacagcactgccagcggtccacgacgactctttggcgtattatacatgccgcccggtggttttgcagcgaattgttgcacgcgcagagcgcgaaaaccttaaaaacgaagtcaggcaccagcactatttgtactatggcccctactatgctccagcatattcatatattcatatggcccatatggaccatacatatatcccattcggcgcctctcattggccgatcaggggcgcttcttgcaaatggtcttcaagtttgtataaagcggtgtataaacgattatatctcgatgctgccggcatggctggcctctccggagcgagggctttcgatcgagccgcctgattcgtaattataacaggttttgtgaatgtgcaagattcgcgctcgagaatcgaccatctctctttgaggttcgggtcgaatctgcaacccggatgatcaagatgagcaattgctgaaaacactgccctacacgtccttcagcacactcgcagtcatctgggagtggttacgcgccataaattatggcagttcagtgtcgtaataaccagagagcacctcaagacgttaaaagcagggtatggacgcctgtagcgcccgaaagagctgtcatggatggcgtgcggtgcctggcgcccacagtatgtatcaaatgtatatactcagcttccgtggcgcctcggaaataggggtaaggtcattggaagtactgcccaccgctatttttgctattaccgccatcagtgtttcctactgcgtcatctttcattacagaccgcggctgggcgctcggtcggtgattttgttcaataggtctcgcgtggcaaagacactcatgaaggtctcgaaaaagatcgttgcgcccggggatatcaatctgttacacactgctggctgtgccctctgatccatcacaaactttggttctctccccaatatcctaacgccataacgccctcgtctgcgacatattttgaggtggacttgttacggcggggaaatgcattgtacatcaaggagacaactgctagtgtatgaagcctcctgcttggtagagtcactcgctcactgttatcgccgctggctccgaagcaggccatgacgacggagagaggggcggggaaggagataacgtaaaggaggaaagcaagagtccgacaacaatacaaaaaaaagtgcctgtggacagaactttcccgaaaaagaaggatgaaactgttcccgctttacagtagatggtctcaatcctgagtgctattgtacaggccgagttattcggccatgaacaaataagcccagactgtcgagtaaaactcaacatctgacgcacggctaatttgagtgattttcacaattgggtagagagaaaagggacaggcaagggttagtaggatcaaggaaattccgagggtgttcctcaatttcatagctggtgttgacgagggccgtagttggtaaatattgtcacattcatttatcatttgtgagttgtatttagacggttgactgaaacggcactcggggagagaatgggggtagtaattaatgggagggactgaatacggctctcacagcaaacgaaagaacagattgttagacagggataaagctgcgtgagagaggtggttctgctcgacctgggtaaacttgtcctcgtggacaggccgtaacagtcgctttcatcaacttcaggcactctcaggctatcggtaaaaaaaggcagatgaaatgtagccgtacgtaatgacagaggtactgtgggcatctttagagtttcctagtgccgtgcgatgcggcattttttttgttgtttctttattcagctctctcgcaccaaaagtaaatttcgcacaccgctcttcgaaaacagcccggtgtgggcccgatacgtggtttagaggggaacggggacggactgacactagaacagcagtggtggagatgcgacgacaaagaagcgccggtatcaaaagttgccaggtctgagcttggtgcggcccaagacaaggccaaggtggataaagcagcgagggaagaataaaaagaaaaagagagagaggaaaaaaaggagatggggagatagcgtgagggtgcgcaattggttagaggggtattgaattggtacacaagtgagcaccaacagtgtgcgaggattgtgtgtgtgattggctggccgcggtccacttgcctgcaatttacccatttgaacctcgctctcaacctgccctcccaggctttgcgaaatcctcggtaattgcagggaagcagaggggaggcagggaggatggagtccagatttgtcgcaagtggtcagttggacagcagcgcctagtctcgtccaagaggttggtctgtccatatatatttcctcgctgctcctgctctccctttttcgctctctctttgctctccccctccctctcttttttttccgctctctttcctcgtttctctctcactctcactccctctctctctcactcttacacgcacgtccactgtctctccctctctctctctctctctctctctctcacttcttttcacttcttcctccactcgactgtttgtgtctctgtctctgtctctctgtctcgactcttttctgctctgcaagcttcatccatctctcaatcccggcacctgttctctctttactatcccctccattcggcaatgcaacacgccgcctttgcctgctctactcttttggcttaaaaccggtccctatagacagacgtacataaaacatacacacacactcgtatttgcacacagacacacacacacacaacacagatatagaatggtcaagtcctcgtcctcggcgccctactgcttcgtcagtgggcagactgaaaagtccaaggcagcttcctcgtacgtattcttgacgataaaaatatataaggcaccaactgcgtattttggtgcctttccccggctaaatatgctctcaggctgcattatgagtattggcgcatctattccaaatatatcctcagctcatccgaaagtccatctgagtgctcgggcgtgcactgtgcagcagggtgcacatggtgacagggtactctgaccaaatgtaaacagagatatctaacctcctcgcgccctaatttccacagctcgaaatatgtccttactatccgccagcagccgcagcgcgcaaaggtctgcggactcaaggagcgggatcgtcgccccatcgacccgccacccattgttcaaatcaagcttgctgatccttcttcagacagaaataagtaaggagcctcgccatcctaccatttcacaagaagcaacaccctttgctctagacatctccatttttactgactttcattccacttgtgtgcgctcgttttgtcaacagggattacctccagagtccctatctcttcatgtgctgtaatctggtccatgctgatgatatctcgggtgagattgtagccccggcgcatcgggctctcgctggcaccgtcgtctcatcactgaaccgcctcaaggatgtcgataactctgacggcggcttctttgtctttggagacatgtcggtgcgcattgagggtcgtttctgcctccgtttcacgctcttcgagctcattgagggccaggtcgttcatgtgatgacttcgacctccaatccattgacggtctattctggcaagatgtttcctggcatgtccgagtccactttcctctccaggagcttttccgaccaaggggtccgcattcgcatccgcaaggatcaccacgtcaagccaaagaagccccttcccagcgacacagtcgacggctcgagcatgcatagcccgccatcctcgtgccacgaggctgaacacagcgatgttgagagtgacatgcacccgggttctaagcgacccaagctctcgacccattccgtctgcagcgattctgtttatgcctccccggccatgagacacattgcaatcgcagcgcgccctacgcacacgtatacgcgcccttcgccatcagagcatgtggaccgcacccctccatcctcgcccggctcctttgccagtatggacagccaagcatcaagaccctaccacacatcctactctaccgaggaaacatctcgacattcagacggccacgttatggcgagaccgcatccgtactacagtcgatcccatgcgcacgataactcatatgctcgccctgagcaagtggcaccggtttctgtatacagccatggtacctacgtgcaccctcgttctcagactcagtctcaccctccctcatactttcctcgcgactctggtagtccaagagagcagtattcttaccacccctcccacgagcgtggccactatgtcgaaggatctccttcgcacggccatgctccgtccctcccaatgggcgctgctcattcgtctcctcgttcctctgtacataactcccatcatcctacgcataaccactcttccagtgcatccttccctcccccacctgtcaacgctggtcgttccgggttcccagcctcgctgttgaatgaccaggatatggaatactccccgtccaaggtcgctcaacctatggagttccgagtgcctcatggcactcactctcattcacgccgccaagatccgtatcatagtcgaacaccgtccatgtcatcgcagcacagtgatgacaacatctctccaccgcatcccttctctccgccagagctgcagcccagccaggtggggtcccagccggaccgcagggggtcctcgccgcactcgccacggtcggtgctgccgttgccgtctattctcccatcgctatccaggccccttgacggcgagaagattcagctgcctccgatccacatgctgtccacatactccccgacgatgtctggccactcttcaatagacagcggatatccaagcagccgtccctgaggcccgagtcctccatgcacatgcacggaataaaataaaacatacaatttgaaaaaaaaaaaaaaaagaaaaagctcattgaaggtgttctggccatccagggcaaaaggttgtatatatatatattatatgcatggatgcggccaccccttgggcaacgacgtgttctgccgaaggagagacagcgagggacagcgagggacagcgacggacaggcttgtcctgtatccaggcacagcgtgcagccaaggccaattctcagccttttctggcctacccaatgatattgcgccacacccgccaggcccttgtctctgctcctttatttacggcagcgctgcccagccctgcgccggtctttctctcttgcttcatcactccaacacgccaccgacctacccgccttgcacctcccacctcgccttcctcgagcccgcctcttgctgccctcctcaataccccactccccataccccgctccccacaccccgccgcatagacatctctgctcgtagaccggcctgcatccctgcttcacgatgaagttccatcatctgctgtccgtgctcccgctcatcctctcggcccagtacgtctgtgctgacggaccccagaccacccagcagttcctcgaccaggccactgccttcctcggcaagggagagtacaacctggcgctccagagctacgacgctgccatcggtaagagtgcactgccccctcggtcgcctagcgttgcgtgcgcacctgcgtatccttctcgaaaatcggtactgacttcgacctctttctctctttctctcgctctctctctctgtaacatatatgatgacaacagaccgcgacccttccaactacctttcatatttcaagcgagctgcgacacacttgactctgggccgcaacaaccaggcgctcgccgactttaccaccatcctcaaacttaagccagactttggacaggccctgcttcagcgcggaaagatctacactaaagcaggagactttgttagggctaagcaggacctggagctctattacgccaaccaccagggatcagacccacatggcgcggaggaggttgcggtactactttcaaacattgacgaggctgctcaggctcttgcactggcaaaggcagcgatgaaggcgggccagactgacgagtgcatccgcatcctgggtccggccatcatgaccgcgcccgtttacgtccccttccggctgcagcgagcagagtgtcatgtggtgcggggggaggtcgaggaggctgtcaacgatctccatcgggctacccacaacgccgcgacgaatgcagagctgatgcaccgactttcgaccatgagctactactcactgtacatgccagagcaggctttggcccagatcaagagctgtatctcgttcgatcctgaaaacaagttgtgcaagggattgttccgcaagctgaaggcaactgagaaggatatcacgaagctggactcggacctacagaacggacgctgggcaggtgtgatcaacaagtctgtggcgggtgagaaggcgcttgtcaagacggttgagaccgagacgagcagcatggaggaggtgaacaaggccgtgggcaagatgccaaaacggttactgctgaaaatctacgctgcagcatgtaaagcatatactgaggtaaggctacgctgctgtgcttatgtgtgcttatgtgtgtgattaggagagggaaggaggggcaaagtccttgagagtagtcttcatgtatgcacatcctcgtcggctcaatgttccatcaggcactcatcctaatatatcatttttatcaattttacagaacaaagacgccaagaacgcattgaaatggtgctcgtcgaccttgtcgctggacgaaacaaatgtcgatggtctagtaggcaagggtatggcgcacatgttgaacgacgactttgaggaggctatccgcgatttcaccaaggctcaggagctggctggaggtcaagaccacaacattcacgaaaagctgagccgggcacagcgattgttgaagcagtctcaacaaaaggattactacaagatcctgggtgttgcacgaagcgctaccccacgagacatcaagaaggcgttccgcaagcaggccttggagtggcatcccgatacgtaccgtggcgacatgagccctgatcaggttgagaagaagatggcggccctgaacgaggcctacgaggtcctgagtacgcccgagctcaaggaacggttcgacaatggtgatgatccaaacgaccctcagggacaacagaaccccttctctcaaggtttcgccggtcaccccttcttcttccagcaaggtggcggaagccccttccaacagcagtctggaggcggaggatttcagttcaactttcaattttagacactccgatcccactttcctgtaacaaaatacaaacacttcaaaaagatacaaacaagaacacactcgtttcacaatgaaacaaagaccactcacagcatttgcgagccattcatacgaacccacaacaacaccagtagttttctcagagaatggcagacaacatgcagatttccatgctttattggaagactgtaaaggcgaacaatagcacacagaatatcgagtgtgggcaagcacccccgaaaagaaaggctttaacggttggacttggcaacacgctccaactcatccttcttcttgatggcataggagttggaggagcccttggcggcgttgatgagctcatcagcgaggcactcagcaatggacttgacgttgcggaaagcagactcacgggtctatatgacacgatgatggagaggtcctcattagtaactgtaaggggcgaaacctcttactctggactataatttgaagaaaaaaagcagtgcgcgtgtgcatatccaacgaatgaaccatctccgtgcagagcggggtacagccgtataacgcgacaaagctaccaaggctgaagaacagccttaggctggaggtcagcgttcccctacatagggtagcttgtggacaggaatgtcaagggtgacgaataggcaattgaaaagccatgaagatacagagtacaacatgcaatccaacagctgtccgccacgcaccccacaattccaggtccaacaaactgcccaagttgggtactgctcgactgccttgcccagtttcacgactgcccgctcccactcgagaggttcatccagaggagtatctccagccgcaaacaccatgaagcgaaaaccaaagataagcaacttacaccgatggtcaacaaggagacagcctggttgacacgacggaggggagagacatcgacggcctggcgacggacggtaccggcggaaccgatacgggtggaatcttcacggggaccggtgttgatgatggcatcgacgaggacctggatggggttctggtcagagagcaagtggatgatctcgaaggcgtgcttgacaatgcggacagccatgagcttctttccgttgttgcgaccgtgcatcatcaaggagttggtgagacgctcaacaatggggcactgagccttgcggaaacgcttggaggcgaaacgaccggcggtgtggggcaggtagacgggggccttgacctggatgtaatcgatcaaggagatatccttgacctcgacatcgtcgtaggaccacttgttgaagaggcggacagcgccatcggtctcaatgccggcaggaagagcaagggtagccatttctataagatcggagtaaaaataaaaggaacatgtttagatggagctaatcagaccaagcgttgtcccatgacgatcttctgctttttcgttcccgtgtttgttggaagagacgctctttgtgttgtgagggcgctcgacaaggataaagagctgcgggccaagtcgaggccgagatccattccactgcaaaaagtaagcgatcaccaagatccatcaccgcgagtgcttatttttccttggtgaatgtaaggacgcagttgctgttgtcctggtgcgggtttcttcatgttccagtatgcccaggtcgttggatgtgcagacggatggctgcgatgtgcggatggatggcatccattgaaggttggatgaacagggcggtcaatttaccgattataggtgatagaggagggaaccaacctgtgcaggcagcagcagaaaatatatagtaccaagccccttaactccttcagacctgcaccatgtaaagtgaaggtctggccgcaaatgggaccacagacaaacgcgctgtttccaggatcggtccgcatccatagacgttgacattcagggtggtactgcgtgcagcctcttctacttatggtcatgtcaagaaagtaaccttgagcgaaaattctgttaacagctatagggtgatgaagcgtggaggtcgagctattgtgcttttcaggatggtcgccgttgcgccctttttaaataaacattaccctgtcgagctaccttgagctctccctcccctcctccgcagagatgtattccagcttggtatctcagtgtccgagcaagcaatctgtgatccggagaaaaagagaagcactgctggctggtccgtttgggcgtgtcttgctccgcaagccacccctcctacttttttatgtctgtccaacgttgcaactttgggcaagcgtcgcatctttccccacaaccccgacccttaacagccagccgtaagtaggtctttcccactgacgagagcattgcgatggtccacttcagcaaggggttggcgtcgtctgcgcttggtccctcttgttactaaagcgggcgagggcctctttcgccaccgccatctcctcagtcccaccagcaaatattttttgtatctctgttttttgagtcacccacagcctctcagcgagcaagatgggctcggacttggggtccggtgcaatgagcagctgagctctttctcggcagctacgggagatggtgcttaggaatagcttcatgaagattccgagcccctcgatggtcgtccgtcgatgcagcctcgggatttaactctaatgtatacttcatgctgtagaaactccccattcttccagctgccctcctttgcatcgtccccggttttgaccacccaagtgaggacatatcgccaagcaacgacatatcgcactcgattcctgaagctctgatatggagtatcagtcagctgtaccaagcaaacgaaagaacagtcaagaggcgctcggagctgtcttcaagaaggcactggtgtcctcgacagataatttcggaaacgatcaggcagactacaacgcggcgactggaagtgtaggtctttccgacactgcaccggcagacggcagcgcagagcattctgtcgggcaaggggaaccagagggcgacaagcctttgcggcaccaccaccagcaacttccgtcctcgcatggcttctcgaatttaagcaacagctccgccgtcgatgccgccagtgctaccattcttagcaccatggctggtattttggcaagtgcaggaggtgatcagccggaacatcgctctgagtttcatcactcgggacacaaaccacaagaccacagccaaacgcattcgccggatttgcaaggggttggtgaggatgtgcttagaatgcagcagcagcttcaacagcaagttccacttgatccctcgaccaacacccggatgacgcgcgagcagatcatggaatcaatgacgagcatccccaccatgcagcagatactcgaggagagtctgaagggggacctggccgcaaaccgcgccgataatagagagacggatcagcataaccaacaactgcagcatccttccgtagaccattcgatattagcaactctcaactcaacagtcagtcaccctagctcgtctcagtcaccagttgaaatcgacaggaacggagcgcagggtagcaagcaaaacggcaatggcagcagcagcaagaagaaggcaaagccaggccgaattctggtcactcatagcagcgacgccagcaaggtcgataacaccaatggcaatgtccagaacagtggcagtgcatcggcctcaacactcgaagaacactttaagagggatatggctgttgttacgagcgacaaccctctgcacaccaaatggttgatggctactgctctcaaggacaaaggtgggtttatgcagaaatgtttggcgcatgaacgaaatgatcactttatcgagatcacagaaagctaatgacatgcatacttctgatacctctgcggcgtcgcctcaggcatttcctacaaaaccggaaccttcagttcacacgaggacgaactgatccgagagaccatcaagcattatgttgcacggcacagcatgccggaggatgccattcagcgatggtttcaaaatggcaatgggcgaggtcgcttcgagaagaacgaccttaaagctctctgggtcgagattggtacgtacaggaaacatgcaagtgtggacggacttgcagggatcagcaattcaattaatatgtactctttgtaactgttagctgtccgcctgcaaaaccgcccgcttctcaacatttacctacacgtgcgacgcatgttccacccccagaacaatgttggcacgtggagcaaggaagacgacgaaaagcttgtcatgctctacgcaaagcataaaggccaatggacgacgatcggaacggagctcggtcgtatggctgacagctgtcgtgaccgctaccgcaaccatctcaaggatcaaagcacgatggttactggcccctggcaaccccatgaggatgaaaagctgctgaccatcatgcaggatctggcgctgcagcagggcaagactaacattctggaatcgagtccaatgtggacgcttatctctgagcgcatgcatggcaccagaacgcgccaccagtgtcggcatcggtattctcagacgctacagcctcgcctggaacgaggagaatggacggcaccaagttcggcagcagctgcggcggcggcagcagtagcagccaatgctgcaatggcagcgagcgcatcgtctgcggctgcagctgtggccaaccaaaatcaaaaccagcaacaacagcaacaacaacagcatctgcatcgaccacagcagcagcaggagcagctccatggtaacctcgggttcaacctcagctcggacagcaatcacgcaaagagcaaacaaagtcaagaggtacttatgctggcggctgcacttcaaggtgtgctcccagaacacggaaacgacaacatgctctggacccaggctatgacaacaaacatccaaggaccagatcacggtcttcacgacaatggggagcagcatttttcgaacgatggccaacatcacggcggtggggcacatgatccatacacggcagccgctatcgccgcggcagcctcgcttcctctccccaccatcgtgccaaaagcccctaaggggcctatccgtcgtcgctgtggactgcagcagcaattggattcactcagaatgattcaggaggagggatataccgatcacacagatatcaagtggtctgacattgcgcaacgcctgcgtgataaagtcgaggagggtaacgcgatccagctggcaagaattatccaaacgtatgatcagctcgattccaagaagcagcagcacctccaggacggtgacagcactgcggcagccgctgccgctgcgtccgctgccatggcagccgctgtttctgcagcacaggctgaggcggtggcaagtttacagcgtgtccctgctgccaaccagatcgccaggaccttcatgtcgtcgcgatgcaagatcgaaggatatcgggaaatgacgctgcagacagtcattgtatttatgatgcaggatgtggagcgccggattcagcaccgtcgtggtgggtcagccaactcaccctctccgctgttatcatccacccaaaccggccaccatgagtcgggagaaggagctacctcagcttccaagaatgtggcgcgcagaaacgctacgacaacaggtgctcttattcaacagcaagtcatcaatgatgccgcgcagcaagctgccatcgccgcactctctgcgcagttcccgttcctgcaacagtatcaacaacatcagcatcagtcggcattggctcatgcactttcggatccagcttctgaccaccaacaccagcaacatcaacaggcgcatcaggcttctcaggcgcaagcttcgggtgtcggaggagtatctcatgctgctgatatgccggatcagtcttcgacctttggtagccacagtggcacggcatctcatcagactctacagcatctttctgcagaggagcagcaacatgagttggagcagcagcaacataatcgcgatctagcggaacaaatgttgagtgttgcattctcgactgctgatctgaatgggttcttctcgggcgccttttcggcctactctccgttctcgacatcgtcttcatccctgtcgacgttggaggacggttcgtcgacagaggcgagattccaggaacatggacaggagcacgaccagcaagcgacgggacgagttctgagcgcgctgcatacagccgagttggtgactgatacaagtgacgaggatgaggatgtgccagaggacgatgcagtgtaaaaactttgcaatatagacgtgtcgtctcgaaaccagtcaaagaaacaaaaaaaaaggtacatggtttatggtttatcgatggtggaaataggatatgtctaaacgagcttggagaagtatttggggacagcctagacattgcggggagagacaaagatggttgtgtcagtttgttgcctattaagatgtgctgatcgacgcccgtttgatctcctagatcgcacatccatccttgttgctccagtccagtcttctcaagattccgcgtcctttgcaaagtttcatgtatcaagacttctcgcaaacagggcaaaactgggccggtgactcctttggcaggcaatgtttgatagtcgaattgcgatccactatttctggcttttacagcactcctgtacgctgtcatgcatgcgcatttgaatcttgcgacggcagagcaatggcaatatagagtgatgagaacgcaacttacgcaatcgttgacgcagtgcaagaagtggtacaactcctcggtgcagtcctcatgggcaccctcctcctgaacacggcgggtgcactcctcaaggtggtgcttcaatggcgcgcaggcagaggactcgccgcaagctaaagaggaaggagaaatggatggcacacaagtaaggttgagttattgaagtgcaagggcggtcaaggggaacgagccgcgcctttctcccccgtgagctttccaagaggccatattgaatatgaagataaccggttgtgttgaacaatcattgaaacgcgcaaggatttctctcggagtggaaagcggcgcctccctccgagtccggtgatgggtggatggaaagtctcctgttggatcaagtgattcccggatcctgtcacattccgctttccggttcgcacgtcttccaagcaaatcacaccacaactgcctcatggggctattgcacaacttcaaaagaggaagtcaagaacaccagagggacgatcctcttaccctcctcaatctcgggcttgatgtcttcaggctcctcctcctcctcgggctcctctgcagcgggggtctcctcgacctcctcgacagcgtcctcctgcttctcctcggcgtagacggcagggaacaaatcagtgatgaagctcaacatggcagtgatcggtagggtgggagagggggcgcggggatgttgttacagtggagtagagaggggaaaacgcggggtgatgatgagtgtgcagttgccaaatggctgtgtttttcggcatgtcggggattgggccttctcgcactaagccacaaacatagggttcctcattcctggctggacgattctccatacgctgacttgcctcgaccctcacggctggcatatttttttcgcgcagcgcgtggccactgccggagcccacgagcttcgatagtgatcatgtatagacctgtgtaacaccgttcgtacaagaatagagaaaaatgccacatggggcctttttacgccggtgtgatctttccataagaatccgttgggatcggaactggatacgatatccaagggcgcgtcaagtggacggcccaatacttgcactggagcaagatcggcaaggctgttcctatggctatcaagatagccttcagtcagcttgagaagcggattgagagatcggcgggagagtcctagatgaatacgccagtttgtcgtccgtcagtcttggcctcaatccaccttcgcgacagtggagcgctttcccgtaggcagctgaagcctattcgacggataaatttcagtaggaccaccccgatacgaccgtctatttgacgaagtgcaaaaatcgatccgacataatcgaatctcctgcatcccttcagtcccatccactttgcaaacccatgaacaggacattctcactcttcgcgaccaccgcctgcctcaaaaggctacctacagcgtcgtcgattctccgcgacgcccatggcccttgcaaggcggcattccgccactacgcgagtggatcgtccagaaagtcgcccttcaaatactcacacccagactccaagagcaagaacgcgaccctctcgccttcttctctcgctacatctaaaaaaccaacaccaacaccagcgccagcaccaccatcgccatcatcgtcgtcatcatccgtacgcacaaccacccctatcactgtggcacccagggatgctgctggatcaagggtcagaaagaccgctggatcagcaggaaacttttcaaagactcttgccgagatgtgtgccaagcagtacgttgacaagcacgctctagagtactttttgcaatgcgggagagcaggacgcacagaaagacagcctgaataaccgacgttgttgtttttttttggcccctcccccttcccccccccaagggatatggtattttacgagcccccagaaacgcttcgcaagacattctggctggcgtacgcgactgcaggactacagctcatcttttggggaaacgtggcccagtacgccttcacacactacaccgacaacccaatgttttcgtccactcaacctccacctccgcccttgcccctgcccgggaccgaggggattgagcccgtggatgtgccgttggcacctctgcggacacgaatcatcatctctgcgggcctggtgggtacaggcttggtgattgcgttcggtatctgcgccattccttggaggtatgagtctcaaacaaacaaaaaaagacgttcgtcatttcttccctttcgatcttaacattcactgacggaacacccttttatggattattttttttttctaagatatgtgaccaagttgacccttttgaggggtggaacgcaaatcaggattgagacaggacgcaagttcccaacaggttaccatcgtagctaccccatccaggatatgcagtgccgtcagcagctcgtcacccatgtgggacctcagggaacatcccccgtgaaggaaggcagcagtgctcatattatgcttgggagtaagaaggagagaatggcattctttgtggatcgacggggatcattcaaggacgcttcgttgtgggacaaggtcttctaccgcccatacaattagtttacagcttggatacaacgcccaatacacgctcctgaaaaaaagaatagctgggtgaattgagcaactgtaatagaacttagagcagaaaatggtctattgaaatggaaccaacgtcattatgttgggcgtatatgtatttaccagtactacaagaaacgaggaggggagggtattacagcaagttctgtgtgtggtggtagggggtgtgaagatgtggcgtgtgcagcagcaggttttacattctaacgacgattgaaaatgcctccaaaggcgctaggcttctcgctcgacacgaccgtgcccgacgcaggtgccacagcagccggtctgaagtttcgacgaccaaagctccagaactggaaaatcatgcccaacacggccaggcccacaaacgcgcccagcaatccataggctccaggggtttggttctcgaaacgaacgtcctcaatcgggttcttggagttgatgaacgagtctgcctgcagggtgaagcctgtgtggacaaacatatcgacgccaatcacgaacgagtacgcgcccacgatagccgatccaatgatcaccatctcacgttcgcggcagaggcctaggatgaacccaaccacggccattgacaccagcaagatgatgcggcctgtaccggaggtgatcagaccaccggatttcaagccaaggatccaaagccccaaggagtagaacgccagggcgcccaggacagccacaccgagggtggaacagcagattaagagaagaccacccactataccaacgccaatggcgacaatcagcagccaggtctgggagactacaccggcattggccatggcgatgtaggagacgttgccaaagaagtagaagccgatcaagaacatggtgacatggaagaggcggtatccaaagaaggagaggaggaggcctgcagcgatgaggattgcgcctgcgatgccggcttggatagagacgttgaagggtccattccggacgtccccgaggattctgtttcccacgtcctcgatggctcgcttgtcattatgtggcactggtgctgctaagaccacggaggcgaagagcgagatgaggctggagaagagcatgagaaggtacacgggtgcgcattttcgaaaactggcgcttggccgtgtacggtgagggagcgagctggatggccgaaggcttggggttgtggaacttgtcatgttactgcgagtcgagtgcgagtagatgttgagtgaacgatggtgaccaaatagagatcgtgtccgttgggcaaagatgtggaagataatgagctgttgatgaaagtcaggccaagagcagagacggggttgtcttttatacagctgtggttccacttcggaagaaagaaagtgagagactggccaagagtatatatccagtgcatacatacagcacaatatacagtctggcaaatgtggtcataaaagcaacagccctgagttgacgaccctgaaccaatcttaaaggcttttaagtcgttgagggtcaagggttgaggaaaagcccaaggacgaggagttcacccctgcactggagcacgaaaaccttccggtgaccctgactgcacatggaccatatcaagcaccagtatactacaagatgcagcatgaatggggcatcggtggttaggacaccaccaataaatctggagctctgacattgaccattagaatatgggttcgatgggtccgcctgctcgtgttcgagcgaccttgtggcatcttagcgccaactatgactgacaacaaagctggctggtgcaggccaacaatagacgtttagatatttttagcccctgacgatggctaagcaaaaaaagcaggctgtgcctcttctattttcatttttgaccctgaccgcagaactcgccttccatcgattctacggcacatgtaccatccactgcataatgcatgctgcggtgctcacggtacctctggtgtctttatcatcgaactgtagatgttttattcctgcttcgaatctgcttcttgtatcaatgttgcaggtaactggtagccacggacgatgctgtgaacgaccgcgccctaagcgacgacggccctccaaaagcgtcagctccactgctgtgacgaaaaggaccagggcctgttgctgaggactcgtacgagccttgagatactgcggataatcctcttcctcttctactgcccgccgattcgcgtatcgatccttccgtggctgaacgatggctgttcactcctgaccttgcgcttgtattattggtcaccattgatgccgttgtagtagactgggaagggttaaacccatccacacgagacgccatggacccacctgatgacccgcctgcctgcggccatagagctgggctgtctgcagagggcggaggaggcgcccgttgaagctcgatagagtgatagctgggatacacaaagtcctcagttatgaactttcgaagctgttcgaccacaaatctctcaatcttgcccacattcttcagtacagctatttgtccaaagaaagagtcaatggattagcactccgaaagccgtctctgtaaagccatcatgcctccgttgtgaggttcccatcctaccgtgcttttgttcatcgccgacttgcgattcgattctcacgttcgaaaggatgctggtgccatgtagattgtgtgcgaagtatattagcataagattgacatattagccgctgtcaatgatgaatacatatcaatcggtaccttacctttcatcggggtcctctggctcaagaaagcacacattgacatggtcacgcaagtatcccatcaagaccttggctatagacagacgccaggagacggtgaaaagttcattgtttgtaagttcgattcgtcaagggggtaaagacgtttctgcggtgctttctcatccaacaccttcaacatacccttaaacgaaaatccagtaatgacaagtttaacaggaagcgccaagaacgcaaatgtcgggtaattcagtaacatctcggtctcgacagtgaaacccatctggccttgataattcaccgagagcagcagttgtatatcgttctcattccgctttgaaagcgttggcgaggtaaacataggtataatgggttcacttgtttgacgatatcggcttgccttgggttgctttcgtccctttctttccgcgcccctgtgctgcctttgaccgtgatcctcctgtagcctttggtatgagctgtcgccccgactttgctgatcctgcgagactgatcgcgagagcacagcacctcgatttccttgggcttcagcactttcttcgtccaggcgctcaactacttttgggcgctgtgaaaatgcgtcgtaattcaacgcttccactggcgacacgtatgcagaagagttatgcagcctcttgtctcggtcattcacaccatttgacgaaacagatgctctgtcagcagccattgaagcggatggtgtacgctgcattggatcatctcccatatccgaaaaactctgccgccttgaaaatgctagcgtgggcgattcgaaccctttgggagtgcttgggatcgtccttgaaggcgtaccggctctcaggcccaagagcgagtttcccgacagcaccatgcctgatagatccggaaagtaaagctgaggcggctgttgacccgagcgtcctgtgggcgatgttacgctagctgaggatggagcgctgtaaaaggaactcgctgagagtggccgtgtcgatgatcgattctgcatgactgaagacaggactgatccaggacttgcgcctatacctgcgccaaagcccagtccaagacctccgttgttactgttgccatggctagttcctgctcctggtgtcgttggaaaataagcatttccgtgctggttgtgttgtttgtggtggtgaaggggatcctccgatatatcaccctctaccgaagcaggcttcagggggagctggctagtaggctccagtgccatgttcttcatgcgttggtaaattgttgattcgccatgggtataaaatgcctcgctctcgatctcctcatcggacgcatgagagcttagactgtgcgacgttcccatgctcctggctgaagggatctgagaagataaaggcaagcttgcctcgatgtccaacttgagattcgggttcgggcgttttatcgccgttgatgccctactctggtgcctcaggttgtgcgatttttctgaggacgctgatgaggcggttgaggaaggcgaagccctgctcaaggtcgatcgtcttgatctgagtgggttttgggttggcctcggatatgcgccagtatcctgcccgagtcccgattcttcgttgcgactgtggcctgtcctagatgtatatcccgcttgatccccacgacgatcattaaggacgcctcccttgtacgaatcgccactgctgcttcctgtagcactcttggtgcgctttccatggttctggcggagccagtcctccgctctcattctatcctgttcctcctcctcgtatgctgctgagtccaaatactcgatatcgtcgccttctccgaccatgacgatgctctcatccgctgagtaaggatagtcgtcgtattcatcctcgtcactcgcgagttcgtcctcgtccagactctcgcctccgcctgcatcggctgcttcctgtgcaagccgcgcctcttcctggtccatgtgcacataccattcttcaagtgggtcggtcacgtcgagcactgttattgaaggtggagtagacccaaagcggaacttggagacagcaatgttgcccatgaacgcaggcttgggtatccgctggaaatgagcgtgaatcatgccctcgatttgcagcgcaacctcatcgtccagcttgtcccatgcgaagacaaaagacattttgagtagagtcctggagaggtgctcgtcgtcgttgtcgtagatggagaagagcgggtatcgtggagcaagcgcgttgagttaggaagatgtgtttgtgaaagagttgagtgactaaagacacctgatttgtgactgttgaagaaaagaccctaccctggtaccggcagtgcactgggcaatgcgagtgcgatactccttgaggtgcctgctcgctcctggctgttgccatatttctacactcacacgcggagcgcttccagtacaagcttaactaccaaattctactcgtactacttgcctggccctccttgcatatacgcttgccttgtcagatgtgaaagtagactgacgatgacccaacactgtgccttgcaaaaatgttgttctataaagtgtaatcgacatgcaacaaccacacgatagtccccaagtgttaacgcaaggaccgagggcttacttttatgtcgtgagcagatcaggggctactattcactgtttgaagcggttccatgcacgcctcaacgagtgtgtgtgtgtgtgctgatgggtgtcgtgcctgcgtgtctttgtcgtcgagtggtcaggccagaccttccccctccccccttttttttccggcgcgaccgagcggcctcctgcgaaagaaactagtgccggccttaaaagagcaaaacaaactcaacctcaacctcggaaaaacaagcaactgccgcgctcgtgaactttgattgggaaaaaagggccttcgtgcttggagcgctaccagtcgccacggtcatcatggatgaaagggcatggcggcttcttaggctccatgctggctgctaaaaccatgtgcctgtgcgcaatactgctagactggtgtgtcatgagtgcctggatatggtcgtcggaaaggaaagttttggaatgataatattgtatatacacaagagaaatgctaaaatcccgagccctgggtgttgtgagctccagtggcaaatagctgatgcacctcaccagctcatgcatagaaggaggggaaaagcacacagcgagagctgtgtctccgaccccgtaaattgaactgcgcctgggcggtgcgacattccatcgctctgcatgtcgcttgccccagcttcattttcggttatggcggggaatgatcgagaactcggtctatctcccgaatatgcacatgcagactatgatacccgcagggctcgcaggtctagctcaggtaatcgaataatgtcgtgtctctgtcaacagccaggaaaataaactgcagtgaagcatgacttgtactgtaaacagcattatacaccgcacacatctaaacaacaacaattcaacacacaacctccacaccgtttcataaggtagcattccatattcaacatccgcgcgctttgtaacctctcgaagtgggcaggctgctgtacgacagtgtcttttgagtgtaaacagtggctgtagaacgcgcccgtccgcggtatttttaaatgctcttcgatgtggcgtgccccgagcctttcaagagtctactgtctgcaccattaatgaaaacgagtggtcctgacccggagataaataagaagaacgaactctggccttcctttttactctctgtcttacccccgtcgccgcacccctgcctgtgtttctcaccatccgcgtttctctttgaccccattcctatcttttatatacgaacccccattgtccaacttccctccatctcctcgcatcctcctgatctacctccattctcattccaacgcacagcacatcatgttcttccgcacagccctcattgcgtctgcggctcttgcccttgtcgccaccatggtcgagactcactcctgggccgactgtgtcgactggagattcaaagaccccgctaagaaaagtaattttccttgacagggccacccacttttgttcttgcataccaaccatcaactcgcttttttttcgcactctaccacatcatttacaaaataccgttttgccgcaggatttgttttcgtcctgtctactcctctcaaaaaatcaaaggcaacaaagaaaaaaaaaaagacgaagatagacgacgcggccgtgtgtgggctctgcacagatgattgctctttttttcacctctcttttctttctttccaaccaagcgtacctctgctaaataccggttgcttgagctctgcttttctttgctttccgttgcctttatacctttggaagttgcgactcgtccatccatttccgccagaaaagaaagaacggctttgtgtttgcgcttttttgttcctgaaatgttattctggggggggggggccgatcaatccttgattcggtttctggaacaagcgtttcacatcgcttcaccccgcgacatatcctacggaaaaaatacgtcctctttttgagatcggaagtacatcgcccggtctcagctgctgctgacacacgctggctgtttctcatctactaccctaggttttgctgctggtgacggcacctgcgttgcatgggctcgccagtatcccgtgaactccaacgtcgtctttggaggtctagacagcttctcgcccagtcgccattatcagcaagaccctaaagatttcactccctgctcggaccgcatccacggtcgtgaacctggtggagatgagacccgccagaaccccattggcaaggcctacggtggcaagtggggcgccatggcaaaggcccaggcaggtgccgagatgtgcatccgctggcctgccaagaaccacgctgtcaagagcgagcctgacaagggagtctttatcaacatgcccctgacgcctctgaacagcgaccccaaccaggacggtttcaaaagcagcaacatcgccaagctaccatacaagaactgcaaccagattcctggtgataccgaccacaccccttgcggtggatgcttcaccatccccgcaaatctcactaccggttcatacgtcgtgcagtggcgctgggagttgaataccaacgagttctacacgtcatgctgggatattgccgtgacagctgccggcaccagccccaacgccaccgagcccgtcatccctcttggaggcggaacctctgtctttgctgaacttgctgaggattaaaaaaaaaacgttcaagcgcttttttttttcatctctacagcagtgtattttctctcgtcatcgtttcttttttttctgtatcaccagctcgctcgtttatgaacattccttagtctcgttcgttgtcgtgtaatcttactctcagtcggcggcggaacgaaggtgtccagtggaaggggccggtccccagaagcatcgtataccttttcccctgtccaccttttccctccttcaggcgacctttgtctttatcatagttgatacttgcttcttcactcgcttcgccctctcccaaaaaataaagtcttgaagctcgcgtatgaatctgcactaacgccctacaagccataccggaaatacacatctgcaatacacactgtttctctgtttccacgacgttattcaatagcgcctctcctgctgttcaggccctcgctctccgtttctttctagccctcatcgttgctgagttacatccctgtaaagatcgcctcatttcacgccatctcagcaatgagcaagcgcatcgaaaaacgcatcccctcactctcctgagaagccccgggttacttagtggaagtgtgagcatttttctcacagcaccgttgtctcatgggtccattgttaatattcatttcgcattacccattgaatctcactttttttctagcaaacaacgaaaacgcatccccaggtctagttcgcagacaccactttgcttaagccaggagcaaccgttggcttcgtaggctatcatcgagaagtgtcactcccggccattaattcgcaatcatgaaaataagcagcgcccatggtaggattgaggcaggtgtcattcgtactggtgctcatacttgaaaaggctgctcacatatgtttccttgactttagcgcacaacaggcgtgtgaaaaggcagaggaaaaggcagaccagctacgattatgcaaggagaatgcgatctgggaggaagctgaagaagcagcggatgattatgaatatcaacgtatgctcgaggctttccaggccgagtccctcaagatggcggccatgaataaccagcggtcgtccgacaccaaaactcgcactagccttcctataagatgtctcgtcttcaagagtatggtccaatggaagaagaggaagatcgtctgctgggaatgctagaaaccggattggtgactgaagacaatctacgcagccatcgactcttggtgccacatggtcaccattcagctcgcaacaacgttcaccgacagacaacagggaaggaattcacagaggatcagtgcttcattattctgttgtcatgctgaaaaactatattcatagcacgcgatcagaggttgatataccggcacttgcagctggccctgaatatcggtttatcgactggagatcatctggtatattaacggtttcccctcgtttggcgctcactgtagatccacgccaccaataaaaaaacggtccacacctggtgattgcatatcttttaagcggaccgtccttgtagctttccgctttctctttcctccttcgccatccactctctctctctctctctctctctctctctctctctctctctctctctctctctctctctctctctctgttgccgtctccgctcccgtctcctgcagctatttctccgcctttaatatccatttttacttttgcttcgctcttgtcttgtttgcttgctcgtcgcttgtttcctccgacccaaagactcggccgccattttgaccatcgcagccagctagctccaacattcgcttcctggaactgctgatcgtttgacttccctcaacccactccgcgccagagaatggccctcgtcaatgcaccgcagatccccgtctccttgcatcagcccaagcctgctcaatgcaagttcaacctcagttactactcaacgctgccgcacttgtccaccccaactgcacgccctaacgcgcttgcctttcttgtcttcctgctccctgttccctttctaccatcgtttggccctactcgtgcctcacagttgccatctctagctttgcgcttcaccatgccgcttcctcaccagccctgagcgtcactcttggtgccaactccactttcgcagtccgatcacatacgcgggaactagtagaatacgtccaggatccagggctcaactgcccagacgccccttcctcaacaccgtcgacagctgcagagtcaatactcaaatcgcctgctgcaacgcctgccctgctgcttaaggttcaggcaggggaaggctttcgattgtcgtttgagctaaaaagtcacatcaccgagttgtcggcatgtgtggcacccagctatgcagagggcggagcaggtgagagcaaagcaccggtagagagtacaaacttggatacgtgtcgatgtaaacgaagcaaactcacaagcagcctctcccatactgtttgctgcggtcatagatgcgacactaggcacagcgaacgacaacagtatcaagcccagcacctcagacactgcgagcggtggagaaagatcaggaggacatgagtgcccttcgctgccaaacagtaacggcttgacgtgtccagtgtcaactgccaaggcagagatgatcaaggacgacaccgatcatgaatctgccacgttattttttgcggagtgtggctcggagcaggatgtgcaagacttgtgtcaggaacccgagtttcagagacaggtacgcccaacgcactggccacactgacagcgatagcgtaaaccgtccacacaatagagtccacacagagactgatctgacggtctcgatatgattcttgtactcgatagcgtaagacccattccgtctccgccgtcatcttgtcctcgccgcgatccgatcagttaacaacggcaacccaaagttggagctggaatttctcgccaaaagatcacgtcgaggacgaacgttggggtcaaaaggccgtgtttgcgtttctgcatagagatccctccaccaaatccatcgtcgtgctgtcacgcttcgcactatggatcgcacgagatcgtgatttaggagctcgatgtgcggcgtctctcccatcgcactctacaaacaacagccgacactggagaagagcatcgacaccagaacgatatggctctagcgttagtagacttccgtcctttcacacaaaggggctctcgattcccagtagccacagctcgctttccagcttaccggatgccgcgacgggggtaggagcacaggatggactggcctatgctgcaggacattcaacgctcagcaatccggcaccctttgctcatgacacagaggatgggcctttattcagggccacagtggtagagtgtgaaaatcacattcgcgatatgaaagcagcaacgaagcggatcatcaaggctgcgcagagtgtgctcgatgcgcgtagaggttgggtcgccgcggaggaggtgcttatcaaggagatggaggggttcaggccagccgagcctctccttagctcctaccttcggcccatgatattgagtctcagtgagagatcagacatgctggcccagcagatgcggaacttgctgatcgaaccactctctcgcttttacggcaacgacgtcaagattgcggaggctcatcggaaagcatttgacgatgagagccgagagtactaccagttcctgtcgcggtacatggcaatgaagcaggagagcaaccgtaaaaaaagcgaggcggatgccaagtatgagaagaaacgccggcactttgaggtcaagcgcttcgaatattggtgctttctgttggacatgcgtgtgggcggaagcaagagcgacgagatgttgcatcacctgacaaactactcggaaaaacactgcaggaacatcatggagatcgcactcctggcggattccttgaaaccgggtctggacactatcgcatcagatctacaagagtcgcacaaacgagcatcaacagtcaggcgagagcgtcaagagcggaaaaaggagctgctcgaggctaccgacgagaacctttgcgtcccccacccttcctccgcactcacaaagagtgggtcaagtccgcccatcttcaacagcccagcgcactcttcgtcaacaaatagccccgacattactctagagcgcaacctcgacatcccaaccccgcatccagaggcctctaatgaccatttagaaagcactgcgggatctgatacgaacgcgtcctctgcaccggtactcaagctgccatcagtgtttggatcggcgacgtcaaataacagcactcctcggctcaccgccacccgcgatttggagcaacaggacgctgaaacagattcgacccaaggaagacgcaaggaaggatttttgtttgcgacgagccgccctagcttgcacaacaactctgtggttctcgagaagcccagcattaactggcacaagtattggtgtgtcgtttcggaaggccatctgcatgagtattcgcattggaagaagggggccaccatgcttcacaacgagcctataaacctcaagatctcgactgtgcgaccatgtcggaatcaagatcgacgcttttgctttgaggtcatcacgccaaagtaccggcgagtctatcaagccacgagtgctgaagacatgaactcctggatcgtcgtcatatcaaacgcaattcagagcctcctggacgggacaagcagcagtcaaaatctcggactctattcttccaacagggatcacaaatcaagcggtgtgcccggagttgacggtctcatgtcggctctcagcggcagtggtcgactgagcatggacatgtcgttgtcgtccaacccctctcacagccatgagcgggctccctctggcaatgtgacgcacggctttaacgagctattcaaaagcgcagagtggtgcgccacagatgacgcggaccacctcgggacacggctactccaaactatgcgggatgccaatgcagccaactgcgtctgtgtagagtgtggggccaagaatcctgactggtgcgccatcaacctcggcatcctgatttgcattggtaaggcgcgtgcgcttatcatgaactgtgtgatgaaaagcagaagactaaaacaactcttgtgtgacatttagactgctcgggcatccatcgaagtctgggtacgcatatctccaaggtccgatccttcaccctcgatacaacctcttatacccgggacctttttgaattcatccgcgctatgggcaacgagacctcgaaccgaatttgggaagctagtcttatttcatcaacttcagagactcaggacggcgccaagactgccaaggccgtattcaggaaaccaactgtcaacgacacgcgcgattacaaagtagcgtttattcagaagaagtatgtcgaacgagcgtttgttgatcatcaatttttcggcgaccgagaactgccagtgagccagatggtggaccggaaggcgctcgcaacgaaggcgctctttcaagcggcgatcgccaacaatatccccggcgtaattgcagcctttgcggctggagcagatctaaatgctgtgcaggaagtggatccagggaatgaacaacgctctcctgaccatgctacaacggagctcgacgacaccatggccttctctctgagcgatagctgcgatattccgtcaactttggacttttccctgggctcggaggcagcagggcgacttttgaaactcccgacggagtccacgaccttgaacctttctagaacagcgtcggatgctgggtcgtcttcacgcacggatgtgtctggtgcttacaaagtaatgcagacgtcgccgcttcttcttgcactgcgtcatggcgtaccgttcagcttggatgatcagtatgaagtctatcccatggcggaattcatgcttcagaatggtgcggcgagcaatctgagtgtagaggtcaggctcatcgacgatgaggcagagtcagtcaagcaggcgtctgttccggacagcgcaggagctcctgccgaagtcacctcggtggcggcccaggatcctcccagctctgatagcagcaatggatgggactcgtctcaggttgacccagaggatattcgacaccatcaacagaggtggaaccgaagaagcttgggacaagttgtccatatgcgaggagaggagggcgcgactgcaatggaatatcttcgagccaagagtgctgcgcgaggagaacctatgccaggatcgccgccgacaagccaaggcagcgacattgctgcagcaagctctggccatacgctttcacctcggcttcgaccacaaggaggatctggatcagccatttcgtcgccctcgggttcggggatctatgccaccaatgtgcaccgcttccaaccggcatcctctcaccaagacatctccacgctgtttcaaggtcgaagagagagcgattccagtcatgggcaagcactgctcgcagccgcgagggccactgacgcagacagggcatcccgggtgagtggagcgcctaaagggaccgagttcacacttcaatcagccgccgccatcgcgtcgtcacccgtttcccatcaagaccaggcggaggcgtcctccggacatctcacaccgctgctgaaccacacatccagcagccgcgcgaacaaggtgaaggcttcgctttccaaaagtttgagattgtcggcggcctacatcaagaacaacatgatgaaggacgacaaggatttgttgcaggcgaacacgtcgcagcctgcagcaatagcgacgacgcctgctggtgcatcctcagagtcacccaagccgttggcggcatcatccgccagtgtgaagtcagtcgtaagcaccacctcagctgaggcactctccacgtctccagcagcatcatcgtcctcaagttcggcccagcctcagcctgaaggtccgttatctggcccatacgtgctgctgcactcaaaggactctcctccggaatctagtatcataaccagcaccagtgcgaagctcgacctctagacagtggccccactctgccctttaaagcataccaaatccctcttatttatcgcctttatcgtttatgtgtatctagcctgccattcgccttcactctgcgccatgtattgcatcccccgtttccccgccatccccgagtaaatgactttgtacttctgaattagattgagaatgaaaaaaaagctcccgagaaagctttccaaaaattgattttcatcgaagaaaaaaagaagatacaagtctgaaagttgccttccagcctcataccatactctctccttggactactcgagaggagcagagcaacaagagacatatgagcttcccaaaggagacgcacatgtgatgacaagaggatgagaaagggcaagcagcttggaactctttttcctccttgcttgtttccagccaacacgccgccacgcacctcccgaaggacgattgtttgagacggaggggaaaagacaaagcatgaaaagggcccaaggaaacaaacaatgcgatgggggccatcattatatatggtccgccaaaaaaaaaaaaaaaaaaaaaaaacatggtcactcggtggcttgccatgttgattttttataaagaggcggtcttttttttgagatctctcatccccctttcctactcacttcacccctcgtccaactcactctatcgcacttggtaagtctttcctcctctcgtctccatatccctttacgtcgctgtcaggaaacaaagaacgcataaatgatgattgcttgccgccccaggcagaaaataccatgttgatcagcttagcacatatttctggatctgaatttgcattctcctttttttttttcgtgctttcacaatcgttttttactttttttgctttcaaacctcatatgagggatggaaggactgaagagctcgattgtggatcattgaacaaaaaaatagccttgacacagcagataatctccagaacgcgaaatcatcttgtatcatacattgatgctaacgatgtttttttttaaatatctttttctctcagatcttcacatcattgctcttcgcaaaaatcaggagacgggctgcaggatataatcaaggtaaatataaaatctcgtctcaacggacgcgcgctgggattgagggtcgccgcgctcacagctccaaggagaggaatgatgttcttatcatgctaattcagaccaaacacaaataatggcgagaaattgtataaccctgacctcgacatccacactccaaagcgtttgaagtgacaacgaaaagatgctgacctctgtctcatctttattctttagatctcgagtaagtttcaagcattgtcgtagaaaatgaagaacaataaaaatatgaactgttcaaagaataaaaatcgtacaattttttttgatgagtggttgagtggttgagtggtgttccagtgcgcgactcacattccacacgagcaaccgcgtgtactgtgctcccgtacgcggagcagcgacaaatttggtcaatcggctggagtttgtttacgcatcgcctatttattcttcctcgttttctcttcacctctttttttttttttttttcctttcgattccaccactttccttgacctcaaaatcaccgtaccctactgtacacaccctcgctcacctcgtccataccgcactcgcaccatgaaactcatcgcctcccttgccgctgtcgcctccatggtcgctgtcactagcgcccagacgttgcagatcaagtaagtgcagagcagcaacggaaatgaagtatcggctgcaatagtcattgctctcgtcacccgttcgttcgcctctgacctcccctttcctcggcaaacgctctcattgtagcaaccccacggagggtactgtttggaacactggcgagaagaactttgtgggctggaccaacaactgcgccagcatgggcaacgcatcccgcgcagtcaagattgagcttgtcgaagggcctgccaccgctgttcgctacgttgcagacgtcggtgtcctcgactgttctggctcgatgactagagctgatgccacagttcctgacactgtcaagactggaaagtactctatccgtgtcctgacgactcccgaaaactcgtatagcccagccttccaggtcaacaacgccaagagccagccttccacgaccgctgcccccacagcctcacccaccacgcctgcaggtagtgccggtcaccacttggcaacaagtggctcgctcgccgttgtgcttggatgcgctgctgctgttctccaatacgtcgtttgagggtgagaatattttattttctgccaggaaaaagttcatcgataggagattttgagcacgcaacctctcctcaccgaatgttctcgacctcacagttgtccctccactgctacttattctctcccttcagcataatattgtatcttttttttactccattgtttatcttatggaacgtgagggtcggtcctcttgttgttgttcgctcctacttggcgaccaccacctttgtttcacgatcacacaaaaaaaaagatagtgcgcatccaactttgtaacgacacactgtacctataattaaaaaaaatattggacgccttgaggagattagccatggtcgttgtcatccgttggtatccatgtgcatgtatcgagcgcaactgagtttttttttacggaagatgccgacacggcgacacggaaggatagcgatttctggctggttttttttacaagtatttttttgttgtttttacgtcgcacaaggactcagctgtgtgtttctcttgtgatcccccccccaactcattttcttttttttttgggagtcaacgactttatcgttcgatgacgaacaggctgcataggctattcacaattgtttacccctctcttctctcctcaccatccgccgccttgggttgttccgctttctaaaaatattatgacacgggcacgttgagctgggtggcatgacaacagccaacataaagtgtgcgaaagccgtctgtgcaggatgcacatctagagagaatttatcatgtgtgtgcaggtacaggcaggcgcgcaggtagcgcctcagtcgtaccttttcagtcgaggagcgcactgcatgtctcaaaagacgaattcacagagaagacgttctcggaaagacctgccggtctctgtggagcttcgaggcagccactactgtccctatgttgtgtcggcgagcagcagaccctctctgtgtgtatgtgcatttgaaggtatcaccacccctctttgggtaagagcctggagagtcatctggaaccaacttgcatgtggtataaacatgcgaggagttgtcaccttggcggtttcgcccttcttgtcgctacaaggcctgtgtcttgtcttcattcgattcttccattgcgtaatacatgtagtatccagaccgtcagtcctgaataagctcctgttatctcgctggcatattccttgtttgcaacaccatgctgtgtttgaacccacggaggagcttggtctgtcgggccaagtcatcgacgcagccatgcacggctttgggagccaaggaaccttatccaggtcggcacagtcgatgggtttcatgccaactgagcacagatggttggctccaagatgtgtgtcggagcaccgtgtaaccaccctatcccgggcttccgggcggaccttgatgacgctgtcgtttgctttggccagacaattggctgggaatcagagaagggccaagaggcccagggaagaggaccgtttttttgtgcccctttttgagactaaggaaaaaaaactttcccctggcaccctcaagcctaccggtctaccttccgtgcctcatcttttctcatccgcactcttgttcgctctcgctctcgctctcttccctgcatcgcttcctttttacccctcagataccgaaaggacaacataccgtcgccatggggctccgaatctttcgtcgccgcaccctgcctatggtgttgatctccttcgccatctcactccttctgctcatcaacatattcccttacgtgttcatcgactttgtctacctcatccgccctctctgggacaaggagattctcaagtgggatgagatcatggtgcactactactctgagggcctgaccatggaggagcgttgccatgctcatggatggaccgtgactccacccccacccgacggaacacccaaggccaaggtgtacgacgccgtgatcttcagtgtggagctggacatgctcgagctcaggatgcgggaactactggatgtggtggatcactttgtggttctcgagtccacccacaccttcacgggccacgaaaaggagctcgtctttgccaacaacaggaagcgatttgactttgcagcggacaagatcatttacaaggctgtgccactgggaccgctgccaccaggccaggagccttggtttaatgagggagcgatgcgagatcagatgacgttcttgttgagggaatcgggcgttcgggtgggcgatcatctcatcttttcggatgtggatgaggttcccagtcggcatacggtggagctgctgagctcgtgccagggggttcctcaggcgatccatctcaacatgcagagctaccagtacagctacgagttcccggtggacgatgggggcaagaacaccccgagctttcgtcggtggacggatgatctttactatacccgcggacaggcctcgacagttttattcgccaatgcaggtaaagagacaacagggatggaactctttgttaggaacaaacaaaagacaagagggactcacctgtaacccattacttgtcttctttcttttctaggctggcattgttcgttctgtttccgatatcttcaggacttcgtgttcaaaatggatgcctactcacattcggatcgggttcgatacagttacatgaaggatccggtgcacatccaggacgccatctgcaacggtgaagatctttttggcatgttccctgaagcgtactcataccgggatttgatccatcgactgggcccgatccgaaagacaaagaacgctgtggggcttccgacgtgggtggtcaagaacagtgacaagttcaagtttttgcttccgggcggatgcaagcgagaatgagagacggcactggcataatcttttggcccacaaacatgtgctcaacttgtaatataatcatcattatttaatcatcgcgttgacagagtacgctttggggttgcgatagatggagaaagaaagagagttggtgtaggagaagggaaagtggacatacgaaattattatactgatatgcttggaattcaggaactctgaaaggtgtcgtcaactagagagagaaaatatagggtttatctgtgtatttgacgatagcgctgcgctcaaagtcaagcagctttatgcgaattttacagcaaaacttcagaagcggccatattgactctgagcgcatttcggtcgcgaaaaaaactagcaaattggtggcaaaagggaggctgctcaagaaagagcaaaaagaatcgcgtcaactgcagggttcgaacctgcgcgggaaatcccatacacttagcaggcatacgccttaaccactcggccaagttgacgaactggatgctgattggttgcttgattccgcatttgaccatgtgaaaccacgtacacgccgtacgttgatcaattagagagggttcgttaactgaatgtgcaaataaagatattttctgtaattgaccgggcggtcgccgccaccaacaatcgtacaagacttatgggctcaattcgcttgctattccgaccagccgccagagcatatcttcgtcaggcatagctgtgggctgacccacatatggcttctgttcttcacgcacgcgccctttgattctttcacgttttccacatctcgaggccttctttccagcattgctgccttcacgcgcactcaaccaaccaatgccgcgctatacctccttgagcatcttcatgtcctccacttaccccactccaaccacgcgcgttgatcccaacctcgcgcacggcaaaggctcaaacgcttgtcctgttgcatttaagtcgtcgtcctagaccgttaagcatctatccacatcacacatttcattcttgtcaacgaaacgcttttagacctgaacctcctctctctcaatctaacttgagctccatagacgcactagtggttcgctggctcacgatcgctgacattccacctccccgcagctcagctcggctcagctctccctttctcgtcccgaatgcctctacactgcagttggtccctttcgcacctctgcactctcagctctcctcaactaccccttcattgcgcatctcgtgggactgcctggagtgcctctcaatatttattttctccaactgcacgtcgctgccagccttacatcgcccagcaaaagctcatctgtcctgttttatggatatcgttcgtattcttacgcacacaccctatcacactttggtgctccacacataatcctctctcatgctctctttacactctccacgctgtttgttattcagggcttgctgcctgactttcagtcaacgtggaatatcacttgcaaaaagacgaatattcgaatgcattgctgccataccacggctgtgcttttcggcagacggtcaagtgaaatactcgagttgcataagggggagatcggaatgagatgctcgagtagcacaagggcgaatatgttcagcgcacagcatgcatgaaacatcgttcccacactctttctgtgaaccaatatttctcactttcttccttatcacacaactcttttcactcaggcacacacctgtatccatcacccattcttcacttctggtgccaaaggtattcacctgcgcctggttgccatagctttttttgactaaggccaaagtcagcaatcaagttacttgaattcgggtacgtaccatcttcttcgagaggctgcgtatacggagataatcagaaagggcatcgcagactcttataattaactgttgaaaatagcccagtcgtttttgccctcgcagacttttctgacaagtggataactatttctccacataattgatccattgagaaaggtagggtatcagacaggagaggcaacatattgtcttgcttgactttgtttctaaccctccgagcaactagttaaataactcacctattcgccaccttagtccgtccatcatgacaaaaaaatccaagtccgcgtttcctgagcacgaccagcaggccgacaacatattagtctcgtccaagcccatgagaaagaagttcttcagcatgtttcggtctgataaatctgaggcccacgccacacccttggctggtcagcccgagagaaagatccataacaagggctttgtgagcatcaatgctgggaatggccagataggcgtcgtctgtgccatcagtagcttggaaacagacactcagcccacggtcgaagaggcgaaggtgcgcttagatattttctccacgaatgtcgccaggccaacagtccaaaccccggtgccaaaatttggcacacgcatcgacagcacgcctcagctcgccttgtgcagcagccttctaccaaggagcgcagccttgtccttatccaacgaaccgaatcttggaatcagcctcccacatgcaaagggagcctcgcaggatacacctagtgacgacgcgactcgaaactgggttaaggcaattgagcagagtccgactgaacagagccatattcgctggctacttgaacgcatggtcgaggagtttgtcaaagacccaacgaaaggatccgccactgtcaccgaggtcgttctccttggacctgtccttgattacgagcactaccgcaagctgctcaactgcttcatccaagagtttcaaaaggccaccattctggatgacgatctgcttcatggccttatccagctagtccaatgtaactccaagggatatcttattgccgacgatttgatcaagattttgagtattcttagaatacgtctgcagcagacggaccagcgaatctcaaaacacccgtaccacctcaccctggcggtctcacggctgttagatgtcatggccaagcacgaggtgaaggatctggaccgcgttgaggagcatgagccattgggtgctgtgttgagctgtttgcaagggagctcggatccgtttctgatataccaggcgtcgtacgcattccaggcactccagtacgtcccaagcaacgaaaccgtcctccaagctatcgtgcggcaatctggaatcgttgcagagagtctcatcggcatttcaggagtgctcaatctgaatgtgagcgggtttcttgagagtctaggtcagctccagaaggcggtcgttgagacgatcggtattgccaagtcagcaatcgaaggtgcccaatcactgattgagagtggaaagggagttttcgaggccatgaaggaggcagtgagctctggcaacagaagagcgtggtacccagctattgtcggcgccactgcgttggtccaagaaggcaggcttgctgatttcaggactgttgtgatggaggcgccttgccgcgtggatccgaagtttcagtgggggatctgtcagttgctcggagagattgcagtggattccacgtgggacagcgccatccgccgtgaggctgtcgactttctggctgggctgtatgccaacgatcccaactggggaaaggatgccagcgtaaaggcgtggattttgaacatcctttgcatcgtttccgagggtcctgagcagtctatccacggaccacatgtagctgcaatcctgcagaaagacgtaaacaaggtgggaactgcccagtgtgcctcgggttacccgttacggtctcgattacctgtgcctgtcgcttcacccttgcttgcccgcgtccaaaagatcccccctgtcgagcgcgagctaaatcagctcagggcaaaacgacttcggaaccgtaatccaaaggtgtatatcccgcctcaagctaaggctagtcttcgagcctctaacaaagactcaaggccgctcgtggatctaatcatggagtttctggacagcgatcgacaagtgttcctggtgctaggagattccggagctgggaaatcgacattcaacagatatcttgagaataagctgtggaaggagtactcagtcggtggacgcataccacttttcatcaatctcccagtcgtgtctgaaaaccatcgggatattgttggcgaacagctgcggacccacaagttcctggatgcaatgatcagggagctgaaggaccatcgggagatggtgctcatttgcgatggctacgacgaggcgcaattaaggaccaatttacacacagctaacaaattcaaccatgaaggacaaccaaacatcaagatgattgtcagctgcaggagcacctatctcggacaagactaccataacctgttccgaccgcagactgactggtacggcgatgacgtggcaagtttgtacacggaggctgtcatcgtgccgttctcgagtggccagattgaggactatgtcgatcagcttgtgcgagatccagaggtacacaaactgatgggcacgagtcgcgtctggagcacggaggactacatgatcaagctgcggtcgatccccaacatgatggatcttgtcaaaaacccattcctgctttccctctcgcttcaagcgctgcctcttgtcgttcaggatggagttgatcttgccatggtcaaagtcactcggttgactctgtacaactcattcgtcgaccagtggctggacatcaacaaacatcggctggagaacatcacacggtcggtcgagagagcgcaagcactgcaggagctgcttgaggaaggatttgctccatacgccattggctttttgatggatctcgcggctgccatattcaaggaacagagaggaaatcctgttgtccagttcacgccgatcagcgacaaagggacgtggaagtctaaatactttggtcctgaacctcgcacggtcctccttcgagagtccagtccactgtcgcgcacaggcaccgagtatcgattcctgcaccgctcgctattagagtacttctactctcgacatatacatgagacacatagattgatgtctgaggtagcactcgatatcgccgaccacccgttgggccagaccaaccttgttcaggaatcatcgattattgactttctcgctgagcatgcccaaggcgacctggccttcaagcaactgctccaccatctgattgagctatccaaaacttatgataccgcaatacaggcagcagcaaacgccatcactaccctggtccgggtcggtgttacatttaatggcgccgatctccgaggcatccagattccaggtgccgacttgagcggcggagagttcgattcggcacagctgcaaggggcggatttgagtgataccaacctgcggggtatttggttacgtcaggctgatttgagcaacgcgcaaatggcaggtgctgcatttggcgaatggcctttccttgtcgaaaaagacgaggtgatgagctccgcgtactcgcccgatggaaacacattggccattggccttgagcatggcacaatccaactgtacacgaccgcgacttgggacagaacacgcactctgaaaggccacacttccgatgttaacagtgtggtgttttcaacgaagagccagaagatcgcttcgggtagtcgcgacaggacagtacgaatatgggacgcccaatctggtacaactggtgttattctatgcggccacaccgaagctgtttggagcgtggcattctcgccggatggtcagcagattgcctcgggcagtggcgacagcacggtgcgactttgggatgcacagtccggcgcacctggtgccattctaagcggccacaccttccctgttatgagcgtagtgttttcgcctagcggccagcagatcgcctcgggcagtggtgacaagacggtgcgaatctggaacgcactatccggtgcacctggtgtcgtcctaagtggccacttctccgctgttttgagcgtggtattttcgccgaatggtcaacagattgcctctggcagtttggacagtagggtccgactttgggacgcacaatccggtgcaccaggtgtcattctatgcggccacacccaggcagtttgcagcgttgtattttcaccaaacggtgagcagattgcctcaggcagcagcgacaacaccgtgcgactctgggacgcacattccggaacacctggtgtcattctgagcggccacacctcccctgttctgagcgtcgcgtatgagccaaacggcttgcagattgcctcaggcagtcgcgacaagacggtgcgactttggaacgctatatgcggtgcacctggcgacattgaaggcggccacaccgaggctgtcaggagcgtggtgttttcgccaaacggcctgcagatcgcctcgagcagtggtgacaagacggtgcgactctggaacgcactatccggtacatctagcggcattctaagcggccacaccgcgtctgtcaggagcgtggcattctcaccaagcggccggcagatcgcctcgggcagtcgcgacaagacagtacgactctgggacgcacaatccggcgcagctagaactgttctaagcggccacacggaccatgtcaagagcgtggcattctcaccaagcggcctgcagattgtctctggcagtgacgacaagacggtgcgactttgggacgcacaatccggtgcacctggcttcgttctaagcggccacacggactatgtcacgagcgtgacgttttctcccaacggccagcgtattgcctcgggtaatgacgacaggacggtgcgactctgggacgcacaatctggtgcatctggtgtcattcttatcggccacacaaactgtgtcgagagcgtggcattttcgccaaatggcgagcagattgcctctggcagtgacgacaagacggtgcgactctgggatgcacagtccggtgcacccggtgtcattctaagcggccacacgcactatgtttggagcgtggcgttttcgccagacggccagcagattgcctcggccagtgaagacaacacagttcggctttgggacgtggaatcgggtcaatccatggcagtgatcaaggatttttattcggaggtctcggctattgcctggaaagccataggaagcgacagctacattgcaagtggcagtagcgacaaatccgtccgcttatggaaagtgacaagtgattgtcatttcgtctgcctacaatggagttcaggtcacgaccgactggccgtggcagatgccaacatatcagctgtgcggggcttaagccgggtcaatatggaactgttgaagcaacgcggcgcttcgagaagttcagctacgacagggcgtgcaccggcaagatgatttgatgttgcaaatgccagctctctgtcgcgagtgtgtgctcagaaccatgtccagcaaactcgagaagctgtcccaaattctggctccgctcaagacactcttcaccaagcgagttctttgttcaggacgccagtctgcaggctgcaccctcgacaacaacaacaaaaacaacaacaacaacaaccactactacttatttagatgttcaataaaaagaaaaaaaatgtatcaagcgttatatttcatgggcttctgggtagatgagtgtcccgtttcttgctggatcgtggtataaaacagtaagccgtggttggcttgcaaaaggcacaggagaccttttcttttcccttcaacttcctgacatgcgcagccttcgcgatatagtccagatcggcaagaatgatatggtaaacgtattttttttttcataaatcctagacaaggatccacatgaacccaaactgtagcactgacaggcagatcaggaagtggattctgcgctttcgctgtggtggtagaacagtgcctgcagacgactctggcagaatgacatatcttaatgatcgcagctacatgaatgacaagcataaactgtggtgttagaggccaagaacatcatgaggcatctagaatggaatcaacacagatacgcgcagcttctcaccaagaaaaatcctgttgctgcaccagtataaagaaagacggcccagaacacggatgaaggtgccttgtaaagctttacaaagattgacacaatgatgctaaattgacgattgatagggcgagcagccaaagccgggttagtaaggaggtagcgttctagatttgcacgaaacgaattggagtgtcaagtagaaaagatgatcctggtcccttacccgacaaacttgtatcccgagtaggctaccagatccaaaatggggacttcgctcgtgatgttcaagagataaatgcacagcttgatcatgataaactccaacaagatgatggccatggcagacgatgctgttggtccaagaatttcgggacggaatctgtaagacgacaagtgaacttgaattagcgcgcgcattttcactcgtccaggcccaaggcgttctgtccagttcaaatgattattgagcgacctaaaagacgacattcatacttgttctcagttcctgcagagattccgaccaagaggacgtagctgacaaaagccatgacagggatgtacatatcaggggcattgaggtcgtcccttggcgacaagtatccgatcgtctctcctgttgtttctgagcgccttaatgaccgtgtccaaagctaacatgataggacgtatcgcgcgtattagccgctggacattacgtatctcatccgttaatcatgaagatgtacataccttgtggcgccatggaaagacaagcagtctaagcttgttaacgacgtacgagttgctgacattaaagtagggctgaagcgctgcacggttgacccatcgattgagctaggtttgacatttgcaagtgcgttatggtcagtgtgcagaatagtcgtcgcgatctgagctgggtgtccatccattccacagacacttgattcatgttgcttgtgaacacagaagcgtcctgctggtcactgctctcggctctttttctcctgtcgtctccaaagctgacacgtaggatgcactcggaacgataaaaatacatcgcctgaaggctgcccttacattttgctccacgtactcctgaccggccatcaccgcagacttgccaaactgcatgccgagctgagttgtgccatcgttgagattgaaagggaaagagggaatgccatgttgaggctgttgctgctgcgggtgaggtgcctgctgctgctggggggtcatgtactgtgtccgaggcgatcctccatagggctgctgctgctgatcaaagcttgagcgctgctgctgctgctgttgctgaggacggtactggttttgctggtaaggctgctgtccctgaccaccctgagtctgggcatagttcatccttggggacggagtggggacaggatccctcatctggaccggagggtgagtggggactggatgctgcagaggtggtggcgaagtcatgtggttccggggctggtactgctgctgctgctgctgggctggctggggctggtaagcgttgggattgtatttggttgagctgtagtatgaaccctgttgcggctgcgagtgctgctgctggtgctgttgctgctggtgctgctgctgctggtactgggcgttgtgccttggttgaggctgggtgtaccctgccgcgttctcgtatgggttcatggccagatgctattgtctgaagcgcgttatctctccctgggtgtccgctgtagggtgctgtgttcctgattagcttgaagagggcgttgagcgagggggcagcgagggatgatgatcacttggaatgcatgcacaacaagaaaaaagatgatgtcctagccgctgctgaactacgtcacaaaagtctttggcgcggacggagggaatttatcctctgcttcccgggcatacactgatcggcgaaacgctcactttcacgcttgcatccacactctcattcgcggccaccgttcgctcaccttctccttcttctcctcctccatctccttctccctatggcctgcagatccacatggggccttgtgcagagactttacgtccagccagcctcatgccaggctaagattcgggccctgcactcgttctcgtgcggcgctcctctgacgcccaaaacaaccgtgtttgcaaagcgcctgtatttcaagtacgtgagaagtgtgtcgtgtttcaataccgcatctacgctgtagagctgtaacactgacaccttccctattttcttctgttgttttgttccacccaggtccagtatgccattgtcccttacccgacacagaccggcctacgagagctcctggcagaggtaaagcccacgcgcctactttgctgctctcatcctatctggcgtccatcacctgcgatgctgaacggacctattgatcgtatataggataccgaccgcaagcaggaagggcttgatcagtgctcagagctgccatatctcaacaaacaaggactccaaggactcgcaggacacaaagggcacgccactagcagcagatcgggacaaggagctggacatcttgaaggcaaaaggcttaaagaaggtacgtgataaccttgcttaaaactaatctgtggccactcttttgaaccgtccagtggaacaacaagcacgcatgctagggctgactgatgttctaccatggggttctcatcatcacgctttgcatactcgctttattagattctcgtgcatgaaaacatttacacgatcccgaactttcttacattttcgcgcctcttggctgcaccagtcatcggatactgggtcttgaaaggaaactacacagatgcatgcatactctttggagtcgcgagtattacggacggcgtaagatttgatcgaattttgtcctttgcgcagtggagccaccacgacactttctatttcatttcatcaagttcacccatgcctcagatctgacgcctccttttttttttctttcgccctattcttcaactacagttggatggctggatcgcacgccggttcaacatgcggagtattgtaggcaccatcctggatcccatggccgacaagacgttgatgactatcctcaccgtcacgctcgccatgcagaacctcatacccattcccatcgcaggcatcatccttggcagggacgcaggattggttctggcgtcgttttattacaggtacatttctcttccggaacccaagaccttcacgcgctactggaatttttccatcccttccgctgaggtacggcccacgatgatcagcaaggtgaacacggtcatccaaatgggatacatctgtctgtcgttgatggcgccagtctttgactttacaggacatatgggactggagtacttggggtaagtatgaagaaaatctcgtccgtcgcgtgcatttctcggcggggcaagggtttcgtggactttgaatttttttgaagctgactttcgcttttgtcatgactagctacacatgcgcggccacgaccatctggagtggcgcttcttatgtctatacaaaagacgccgtcaggatattgcaccctccaaagaagtagagcgccgacttattttttgtccgaaacacaaccaaagagcaaatgaacaatcctagacccattacagttgttatatattgtacaaggcgaactgtcgttttttgactcagggttctagaaaacacattagaaaggaaaaaaaaaactcgttacgaccgcgccaacgacggaaagcacgtcgatcgcatcgccgcccgttccgagtcggagagcatgtttaaatgtctcttcaaatggccaccgctcctcatcgttcgcttgccggtcggaactgccgtattgacatcctctgcctcgatcatagaccgcaacaagggcgcataagcaccaaaggtcacgtcgaggttaaaccgcagaccgtgtaaagacattgtttgctctaacgcaggctgcatctgacgtagtgtcctacgttgagatttacagggaaataaaagcaagtcggttaaagagatggtcagactcaggatggacaaaaactgaacagaggaagcgctggctacgaaaaagtgatcgttacctggtcataacctcattcatcggtataaagacttctgccaaggctcggaccggatcgtcccgcttgacggtgtcgtcaaagacggacggattagccactccatgttgattagccatgcaaaggtataacgactcacaaccctcctcaacaagcccagcaatctcttgatccaaaagcaaatgatccaggccggagggacgtttgagcacaacaaaattctggccaacagtatcatccttgctgggctcgaactggtccaattcataacactttgcaatggaggatggcacatgagaataggttagttcatgtttcccgtaattatttgcacagtaaagtccttcacaaatcaacttgtcttcctctacctggatgactcgctctggtttcatccgcagctgtgcatcactcatggacatgccctcggcgtattgggcttggatttccaactgctccagttcttgcagtggactcggaatactcttcttgtcacttgacatgacaggtgttgaggctcggatgataccattcgcgctgatcctcaaaagacgttgtggtttccgtctaccaggcgatgctggcgggccgcctccgttgatatgatgggcacctgcatggaaagacaccgcgtcggctgaaggactgctgtcacgactcctaggctgaccgttggatgacgccggcgaagatggcgagggcgttgatctggaagatgaggatcggctcttgacaacgccagagtcatactgcagctgcatcaagcagcggcggatgtcgtagcggcactgcataatcaagcttgtcaggtactctgcggagcaaatgaagccttctatcttgcagatcgacgacaaataaaggtggatctctcgaagtcctggcttcgtaaactctaaatgctcttgaaatcttaatgttgcggcaggaattttggaggtatctagtggtaatggagagaaacacttgttagaagggcgatgtgagggagcacattgacaagtgtaaggcagagcgcacatttaacgctcaccattgcatgtcatgacgacaggccgtttgctttttgaaagcaaagtcataatgctcgcccagaatcctttgtcgtcctcaaagagaatatccacttcttctagcagaatcaaagattgccgaggattcgtggttgccagcaacgagtatagatccgagagcgtgtcttgatgattggccagtgaatcgtccttatcttgctcgcttcctttggcggatcctgacggcgacgatgcctggctttgggagccagctctctgctcattgtcgttgtcatcgattccaacaacgtcgacatccgaagtctcgtgcatgatttcgtcctcacttagtacattctggtcctgcacctggcttaggctctgaccctgtctcttttgaaaaaaagagaaaatcgtaggcggctgtacaggtgcctgctgcacgggtgctgctggtgctggtgctgcagccatttcatgaccctttccgcccataatatggtgaatatcatccttgaactcaggctttcctggtacgacatgcacatggtgattctccgccatctcgcctacaagtcccagaacctccttccctgtcctccgcattcctggtgaaacctcgaaaacctcatatccactctcctcagcgcaggcatacactgccgcagtcttgcagctgcccgtgggaccgctcaataaaattgtatttgacttgatgtcaaactttcttggcagaactttggcgccacccatcaggcccagatcttccccttccaatgacaagtctccatgaaccaagtgtgcaaacgacgtcaatggtcttggtgtggcaaaaagaccattgtccacttcgccaaggtattcgtacgggtctccaaaatcgtcgagaatgtcctccagatcgtcgtcgacaatgaaatcgtctagatcatcgtaatctttccgcctcagtcgcttcctgcgtttccgcgctgctcccaatagatctgtcgactttttgctagttcctgcaattcctgctcctgaagatgactcttctggattcagtgtccacccagagacttcgaggcctttcagccactgcgtcagatactctgtgttcccccggttcccaagaacttcggcgcccactgtcggccggtacttttccgtccaaagctcaccaaatcgaagctctgagggtatctcggtcgatccgattgacaagcccgccgtcgaagtcaagagtgatgacgcccatgtttggtgccagagcttttgatcggtcgccacgcgtcgacatgactcgaactcgtcgtcgtccgcgtgaccaaacttgttaaagacttccctctgcctggtggtcggtttctggagacgatagctcctctcggaccattctctccattttgaatccttgtccttcccccaatgcgtccaacattccctgccccgtggcttcagcttgtagacaggcgcggtgatgccaagatcaggagttgatcgcaaggagtaccacctctggtcatcgtgtcgcgatattgctgaacactttggtttcctttcttgcttcgctagcgcctctgccagatgggttggggaagatgccgtgtcgagaccacaaagcgtggccacgacgccgttgagagcatcgatcgtatccgaaccatgaaactgctggtctgagtgtggaaagggtggttcctgaggcttggtgttgtagcgacgtcgtgcctggccgttgtttcctgagactggatttgatcctgcttcaatgatggacgctgcgagcgcctgggaagccttgacctcctgaaagaacggatgcgtctcgcccgatctggatatattgggatccatcatcgccttctgatcaacagcgggttttggcgcgacagccggggccaaagaggttgaggctggtgcggctttggctttgagctttctgccgcgtttggtggacgcctttgctgcctcggcctcctccagtttctttttccgttgctcgggcgttagaaataaggagaagacttgtttaggtgctgctggagacggcgctgccgctgccactgtcgctgtaggctccgttgtggcaatcgttcctggctctgttcctgttagtctctcagactcggatatgggtgcctccaccagggtcgggccggcgctggagccctgggaggccagggcaggtgcatgtgttggcgatggcggctgttcctgcaggatggtggcgtttggggttgagggaagcgactctgtcgaaggagcagtggccgtgtctggatcagaaccggcatggcctgtggtcggagtgggttggagtcctggctgcagcggtgggggagtgggcaccgcagcttcggacatggaggcgtgcgtgggtgggcagggatcgcaggtgacagatgcactgatgactggagcgaatcagcaacaaataaaaacataaaacgacgggggggacgcgttttgaggttcagtaggacaggccaatagcaagtcactctttcgtttctcgctatcactcctgcaaaccacatgcacctttgagaatcacctcgactgcagctgccatgaccctcgtcagaacacttcttcgcagcccccttgccaggacatcactcctcaggcccgcgtcctcacaccgcagccagttccacagctcagcgtcgcatgctaaagcttacattgtgaaatggggctacggtgccaaggacatgcacgtcctcgaggacaactccatcattcctcaggtgagccaactcctctcacctcataccacagctgctaacgtcgcacacgtggaagcgcgacttttgactaacgcataaattacgcttacaggggccgaacaagacctggatcgcggcgggtgcctctcatcggctgatcgccctgtctggcgaggacgaagctggggtgctgggcgaaggcatgaatcatagcggtcagctcggtagcggtgtcaggagtgatgagccaacgttcagtgccatcgacacctcaggcatggagatcctcggactggcctgcggacgtgagcattccatgctgttgacgcgggctcaggaggagacatatgatgatcaggaagcacccccaaggccgatcccaacaaagaccatcctctttggctttggaaactccatgtatggacagttgggactcggtggatcgaaagacacgctgtcaagagaactggcaggtgaagacgttcctggacacgtctttgagccctcgccaacatcagtgcagctttcagatccggacgagaacgtgatccaggttcagtgcggattagatcacaccatcttacgcacaggtaggcagcacatcccaaagcattgtttttgcatattcttgtaagagtcgttgagtactaaaaactgttgtttttatgactggcttgtagatcagggtaacctttattcaatgggatggggagccgatggacagctgggacttggcccttcctcaagttctgatcgtgcattgcccacgctgatcgagcgcttgagctggaaggcagggggaaaggccatcggacgcgtcaaggatatctcttcttcgaccgatttcaccctggcactcctggataacaaccagatctggatttggggcaatgccgagtacggccaatgcatggtcaacaagaagatcgacagggtaatgaatcgcagtcagttgaggaaagctgccttgtgtgacacggattttatagattgtactcacagagagtatgtgcttgcattcgattgccaatagatccttgagccgatgcatatcccccatccgatcccagcgtcggaggtcattacatccgtggctgcaggagggacgtttgggctgttgttgacagattcaggagctgtgtacacctgcggctatggagcactgggtttgggaagggacaagaaccagatccttatgccagagaaaatcccctcgctgacagggatccgtaagattgtcgccagcacggactatgccgctgccatcaacgacaagggcgaactttacacatggggaacatgcggcaagagcggacgacttggacatggtgactttgagacttgctttgagcccaagagggtgctaatgcctcaggaaagcaacgggagcaaagtcatcgtccacgacgtggccttgggccaggatggcgggttggcgatagtcgaatcactttgagcttgtcaaaaaaaaaaaaaaaaaaaagggttcacacaagtcacacaggtagtatgtgaaagtctgagcgctcttccctctttattgcttccccaacgaacccttgcgatcaccccaacactgcaggactgcagccccacgcttgttagacaacattgtcaggcaacaaacacagcaggtaccagtaaggaacgacgttgattcaaggggtccatagagtcgtctgcgaaccatgagcgacaacaaggacggtaccattgcttccgagccagctgaaacagccgcgcatggggacgcggtgcaaagcggtgttgactctcacccacaagggtcagagctaatgcaaggagcaccggcatcagaggatgccagcgaggagcaaccgcagggccagtcctcaaccgactacttttcgcctcaagaacccacagtcaatgcttttactccgcaacagcaggacgacgctgtggggtttgcgtcagaaataggccagcctgatcaaacaacagtgaaccccgaacccgataccactcaccctaaagactcaggaggcctgtcgaatacgcaagcacccccggcctcgtcgctgacggcagccctcaacaataacaccaaccactctaatacggctgggtctgacaggccgggaccggatgctgcaccaccaggatcggctaccccatcctcacaaacaacggatgtgcctgcgacggaaaatattgaccctgttgcatcgtactctgcatggcgcaagaagaaagacacggaaatgttgcaaggaacccaggctgtgatggagtcgtttctaaagcagcactccgcctacgatgtgttacccgtcagctatcggcaaattgttttggataccacgctcttgatcaagaaggccctttcggtcctgatgcagtacagtaggtggctcgccttggatggcacataacctatgcccttttctttgcgtgtctgagcagtttgccgcatgattgcccactttcggactatgccactcatcagggctctcttgcttttgattgaatgcgtaggcatagtgtctgctccgttgtgggattcaaccaagcgcaagtttgcaggcatgctgacggccacagactttatcaatttgattcagttttactactcccattcatcctacaccgccgcaattcatgagatggaccaattccagatatcccagctcagaggtactgtcaaaacatgagagaaagagctcattaagttttacagacgataaaatatctctgctgacttttgctcttttttctctttgaaaaaacttagatgtcgagaaggtaataggagtgccaccgcccgagctgttctcgctacacccactgcaatcgctctacgacgcctgtcagttgctggtcgaatcaagagcgcatcggttacccttggtggatatggactctgaaacaggagaggagatgatcgtgtcagtcttgactcagtacagaatcctcaagttcattgccatgaacgtaagcctacgctcgaggaaagtttttgtctctttattcactcatacctttcctcgttgactcacggctgcgttcttttgttcatgttcatcattttgcgtgggatggaggttagtatcaggacgagaagacacttcgtcaaccgctttcggagctcaagattgggatctatacggaccttgccgtggcagatctttccacgcccgtgatgaccgtgattgacatgttcgtgaagcggaggatatcctctgtgcccattgtcgatgaggacggtgtggttctgaacgtctttgagactgtcgatgtgatggtaatgtatccacgatttttttttgtttacattgttatcgcccaaatcgagtgaatgtccacgtaggacgaacgactgatgagctgtccttctcgctttgactgattttgttaaccaaataaaatagacgctggtcaaggcaggcgtgtacagggatttggatctctgcgtcgcagaggcgttactgcggagaccggaagactttgcaggagttcatacctgcacgctcaacgacagcctctcgtccattttcggaaccattcgcaagtctcaagtccatcgcctgatcgtcgttgacagcggcaataagctgaagggaatcgtcagtctctcggatatcatgcgttatctcatcggtggaacacgtgagaccaaggagcctgcaggtggcaatgtcgaagaggcggaagtccacgtcgaggacatcgagaaggaaaccaaatcgacgcacagtggcgatggcgatgataatgatgcgggagacctatgacgagacttgcgggcttaaaatagggcagcgctacaaacaatcaatacacacccgacatcagaacccgacatcagaattcacgccgaaggatgagtttgggttttgacggggctatgctacgcgaatttattagaatgccgtcctgtaggatcactggtgctagtggatcctcaaagttgagtctggttgtccttgactgactcgagcaaggcgtgatgcataaccgcgtaaatcttattgcaggcctcgacacagtgttcaacggactaggagtgagaaaaaaagcgttaatgatcgataagtcaaacgcgtcactgtgaattccatgtctcccacgtcgcatttggcggagattggcaaaaatgactgatcattacctgtgaaataatagatccttctgccttcccgctttgcagcacatgtgtgacctcgttcaaggaaggcatataggccaagacgatagatccctgttcatacttctcctcctccagatccgcatccataaagatctgtggtggtattgactctgctcctgacgatattgaacgggcgggtccagtctggatataagaggctgagcatcctgcgaccaaatccaacatctcaattcctgcatgggctagcgccaccgaggccgcagtgatggccgcagagaggcaagatcccaagccgtcagactccagaaccgtgatgtaaacctcaatcgcagacttgggcagcagatccaaacggattgcggggctcaaggcctgtgtcaagatctgcgaaagttccttctcttgagggtcctgttgtatttgtgaaggaagtgtatgaacagattgagggatgttaggtctcatacatgtgtggtttgcattttgagtatctaccgcttgtgctcttacccgcatctgatttctgcgctttgcgcaagagaatgtcgcgaacttgatctcgcaggtaagcaagcctcttccgctgaatgtctggccaatccttttaacaggcttgggtccgtaactatatcaacgttcaaattgggcgttttggaaggaataaaggcggctagttagttcctctccgtgttcatgatatcggtcgcgatgaaaaatcaacgcctgcaacgccgcgacaagagatgaaaaaggcagtttcaacattacactccgcaagcaagctttgtcttttccagttcgatgtaagcagatccatttgcctggccgatcagtcctgtcttcaaatctgtcgatagtacaaggtaagaagggagatagatgttagtcagagcgacgccatgttacgtgttaggacagatgatcggcttggacgagcgcgatataaggcacactactgccaaggaccgtgtctgaaggcgatcgatgcacgcttcaagttcctgcatcatcctgaagagtgaagcagaagtaaaaaggtgtccaggcaataaggtccagtgcagtgcaaaagacctacagatgggtcgcatgtcctcgggctgacgcttggaatcatgacgcttctcctgctgaggggtccatcgcttgtggtccacggggtactcaatcaggggagcgacgctcagctctggtcctgcaactctctttctgtccatggtggaatgcgtgtgttggtgaagaagagcgaaggtctagtgagaggagaggacatgaaggcaagttgcgatgaaagtagcccaaaagtgactgcctggctttgttttgaattggagtatccaaggagagtgtctttttttttctttcttttatttttgctccatcttacagcactacataaacccataacccccataccaccaaaccgcacccccacccatgtctgattcaaccacaaagcgggtcaaggtgcccaagccagagaaaaagaagcccaagcacacctccgagacagcaacagacgccgctgttgagacacctgctgcagaggaacctctgatcgatatccccgtcgtcaaaaagaagaaggagcgccgcgtcaagaccgaggccgacatcgcagcaaagcaggaacgcaagcgacttcgcaaggaggccgagttggcaaagaagggacccgctgcagcttctgcctctgcgcccaagcccacattgcagaacaagacgcccaagtggaagcagttcctgaagaactcctccgaggccgacaatgcagagcagctgaaggatacatcctacaaggtcaagggagatgacggctcgggcgatgaagacagcgatagtgacagtgaaagcgatgaggataaggcaaaggcgtccaagaagaaggcagacaagaagagaaagtccgacaaggacatggaaaacggcgcatcaaagagcaaaaagagcaaacaggaggacagctccaaactcgcgtcgttggatacagccacaccaggtaatatctcgctggaaatgggatctcgctcagtttttcgttctcacgggtgtcctagctggtgctcatcagatgtatatatcgttcattcttctgcatgaaacgaacgttaggtttggcttacctggtcgaatggaaacgtgcaagagcaacatggaagtttcaaaagctgcgtcaagtctggctgatcaacaacatgtatgacgacacgcaactgcccagcactcactggggcatctttttgcattatatccacgatttgaagggagccgctagaaatgtaagtttttgagctccagacctattgttcagtgttgattcacacagacgcgtgatcatacagctcaccatggtcttgaattattaatgtcacgctaggctgctgttcaagaagccaagaagatcgttgaagccccagaggcagaggaggacgagaaagagaacgaagatgatagggcgaaggatgttggcgaggaaaagtctgaggatgaggagatgaaggatggcaacgcagagtcagaggaatccaccattcccttgagtgaagaggaaaaggctgctgaagaagcagcgaaggctgccaaggtagaggcgaagcgcgctgctgaggtcaaggccgctcgagcattggatgtgctgcgagttcttgcataattgttacatgactctacaccgatcattctaccaaaacaaacccctctcaccccacctgtacactaaacttgcatccacacgcccataaaagacatgtatggccatagcaagccattttcatgttcatgaagaatagcagagaactttatcgtaagggtatgcgacgtactggacccagctgagagccacggccaattttacacgtttctggtctcagcatggaacagtcctaagtttaaaggtcttacttcagctcgcagtgacatacgttggccccggtcatggatggccctggggtgcaggtagaatagacatcctgagagtgctacgaacgcaagggctccgtgggcgtagtccaacgttgttccgctgcgcttgtatgtcggtgtcacctaactccgagtacaaaagtactgtacagagaagctcaggcacaagaattgaatttgttggataagtacaccacgtagcttccattcgcctttctttgctctcccttttctacttatacccccaccctcctactcatccaccagcatccgctccctccgctaccttcgttccttacacccctctttcatttccgctctcaacttcacccaacacattcatacctcaagcgagccatgtcgactgcttcgaacagatccatgtcgtctgcctcagcgtcagaagagttcactgcctgtgtcaacccaactcccaccaaggctcgtgtcatcattgttggtgccggcattggagggctgactcttgcggccctgctggaacgtgctgggatcgagtaccagatctttgagcgtgctgccatggtgaagcctctcggatcagccctcagcatcggctcgaatgttatgcccctctttaagcagctcggcatcttggatgagatccttgcgaacgctaagccattcagcttctcgaccggctacaacgaacagcgagaggcaactcgcacgcttgattacagtcctgcagagacgatgtaagcgtcttttggtttttttttggtctggtggaacctgctggtgacagtcattattggttcccttggatcgttgaccgttatttttttctttgctctcctctctctctctctctccgatcactcattgccttatccttctctgcatggtgttttttttgtaatgtttgttattccctcgaaattcttaatccagtggtggctaccttcctcatatcatctcacgtccgatccttgtggacattctgctgaagcttgtgcctgccagcaagatcaccttttcgaaaaagattctctcgtgcaagcaggacgatgaaggagtgacgatagcctgctccgacaactcggcctaccaggctgatatcatcgtgggagccgatggcgcttactcgggtgtccggcagaatctgtacaagcagcttcaggccaagggacagctccccaagagcgataacgctgatctgccgttcaacagcacgtgcttggttggccagacccgacctctggatcccgaggtgttcaagcatttgagcgatagccacacttggtttgagacgatcattggcgagaacaagccttatgccgtaaggtcttttgctatggttttgttttttccattgcagctttaagtaccacactgggaacaagtgcacccaggggttttttttacgactatgtgtatacctcacggcccccatacggtggcagagaaagacgccttggtcggtgttctaaaacaagtggactgaacccaatcccctctccgacgcattttttttttgacatagtggatcacgttcacgaccaagttcaacacgatctgctggatggtgctccagcatctggacgaggtgtcgagcaaggagagtgacacgttccgcaacaccgagtggggacccgaggccgcagagacgatgtgcaagcaggtccgggatttcccagttcccaggaacggaatgactcttggtgacttgattgacaatacacccaaggagtacatctccaaggtcatgctggaggagaagctgtttgatacttggtacggaggaagaatggtcctcttgggtgacggtaagtcgactttttttttttttttttttttggcatcctgattttggatttggcgcgcgcgaggatacctcttcgaaagaaggggggtatctgagggcatgaaagtcgagcttgtgcgacgctcaaaagacccacgaaaccctaattatcataattctgctgtatttgcttacaccctcaacctgcacctgtcgatgcgtatccccctcctcaatatgtcagcctgccacaaggtaattagaaagtctagaagctgtgtgtcccgtaactcgctcttgtttgttacgagttacccaaccactccgtacttccaccacctcccattcgatgagtttgcactttgttttttttcttcctttcttttttttttttttttttttttcgtctctcagctcttttctgctagaagcatgtgccatgcatgatgaaccgcttgaccgttgctgctcacaagataccacccgccgtttatatttttaatttccgcgacctgtctctctcgctctctctcttcatctcgcacccactcgctcgctcgcactcaatcgcactcacacacacacaccgaaatggcgatcgatcgtttatctgctctttccatgtagctgttcccatccgccggacttggtgccgtcagcgccatgcaggacgctgtcaccttggctaactgcctctacgagctgtccgagtacccaaccacggacgagatcgccaaagctttcaagcactaccaaaccgagcggtatcccctggccaagagcgcctacgataccagccatcgccttgccatggtggtcggtcaggtaaaacaaaaaaaaatgcataaaaatgcaaaagctaggttgaaaggggaatgattgcctatctgttgactggaattctcattttttttcttttgacagagctggtataacgatgtcttccgtgccttgatgaagtggatgcccaaaagtctgttcacgcgatcgctgtctgtcatgtactcgtatcgtccccaggcgtcgttcctgcctcccgtcaaggatctcggcatgatcaagcctgcgccacaggccagtctggcccgcgctagagccaacgcggccgccagagcatccagagcatccagtcgacgcgcctccagcgcacaggccatttagaaccgtgtctccaccattgtctcagatcaatatattcgaatttttttttgtaagcttgattcttttctttatttgttacaaaaacgagtgtatttttttcccatgagaggaaagggttggtggtggggggtcgtcgatcttttggatgtggagtcgttaccagtttctgttgaactgtccgttgttgttcatgttgttgttgttgttcatattattcatgttgttcatgttgttcattcccatgcctcccatgccgttcatgttgttacccatgttgttacccatgttgttgcccatgttgttgcccatgttgttgcccatgttgttgcccatgttattgcccatgttattgcccatgttgctgcccatgttgcccataccagtcatttgcggcgtgacgcctcccatgccaccgcccatgctgttcatggagcccatacctcctcccatacctccagccatgttactgttcatgcctcccatgcctcccataccagtcatgttgctgctgaggccagtgttcatcgatcccatggacgagcccatggatcccataccgcccatgccggtcatgttgctgttgacgccagtgttcatcgatcccatgggcgagttcatggagcccatgccggtcatattgctgttgacgccagtgttcatcgagcccataggcgagcccatggatcccatgtttcgcatgccagacatgttgttattcatgccagtgttcatagaacccatggtcgagcccatgcctcccatgcctgtcatgttgttgctcatgcccgagttcatcgaacccatcgacggacccatggaacccatgccggtcatctggttattgagaccacccatggtattgttgttgaagttgcctggacctgacgatgttggggggcgcatgtacgaggacgacatgggaaggtggcctgtgggctggctctgaagcggcgtcatgccaacgccgctgctgctggggggcgtgttcataccaccaaagccgcctccaagactgctgttgccgaagctggaggatgaggcaggcgtctgaaggatccgagactgccccataggcgaagaggtgaacgagttggagagagacggggacttgttgaacgagttcataccggtcatgttgttgcttagaccgccaccgagactattgttgttcaaaccgccaccaagactattgctgttgttgttcattcctgtcagagcgggcgtctggaactgtggcgacggagactgactgaacgagttcatgcccgtcatgttgttgttcaagttgctaccgagattgttattgttgttcattccggtcatagcaggcgtctggaactgcggcgtctgcatcggttgagaaactcggttcatcggggacatattgttgttattcatgcccgtcatgttcccgttcatgccagccatgtttccggtcatattggggttcatccctgtccgcatgttgttcagcatgttcatattattgctgttgttgttcatgttgttgttcatgttgttgttgaagcctgtggccatactggtctgcattggtggaggtggcggtggtggcggcccctggctcatgttacggttgatgaagggcgcggggactgcaggtgcagatcgcgcggcgatgataccctgcggcgcccgtgaaggaactcctgtggggttcaccgtgatggcgccgatgccaaagggattggagggagctatacgaaagacggtatggtgagtagactgcataataacatcgatcatcccaatcccccctgtcgcagataaaaaatacgtactcgcattgacccagctggctttgccggtgggctggctagggatgcctgtcatctgacggttgacaccagtcatcatttgctgctgcatcgtaggcagacccatcgatgctgtgctaaatgtaggctgaggtgcgctttgctgcccggtagggtgcgttgggacgaagcgaagagggccggtggggttgacggggataagaggcgcggccagccttgccgcggcagacactggcggaggaggggccatgcggcggatagtttgcaccagctgttgattctggttggcctgctggacgagagcctgctgaagcatctgctgctgctgcttcacttgctcgagctccttcttgacactgtcagaagcctgcttctccttaatcttctgcatctgctgcttgaccctctctgcctcctctgcctgggtcagtgcaatggcctcaagtgagccgggcacgggcgaggacttgacggcaggcttagcggcaggggtagcaggcgaggatggcgtgataggtgccgacaacccaagagcactgagggagttgctgctgtcagtccttccaggggcgccaggtcggggtcgcccagctggagaagattctgcctcctttggcttgggcgactcggtcttggcggattcttcctctggcgcctccttgggtgcggtcgaggacgcaaacttctcgatccattcatcctcattgtcgcgattctggaccttccagttgtcgtagtcaaagccaagtagtttagggtctcgtacttcccatgcgtcgtcatcgaaagcaaggtccgcagccgatgcacctgttgcgggcttggaagtagcaggctgctttcctcgggaagaggacgaggccttgggggtattgctgagagctgtgccaatcttggtgaactctgctgcatcaatgctcttaggagcggacgtgcttgccttgggtctcgtgtctagcgataaaagtaataccaatatgttagtgttttttcatatcatgttgctcatgaagggtctgcggcacagaaaagaaactcactcttgcgctgcggcgtgtcgttcttctttccgaacacgggcacgcgattggtggcattctcgcgttcctgcagctcacgcgcaaactgctcatccgccagctcctgttgtctgcgctgctccgccaacgaggcgccagaggtgcgggcattagagacctcatccgcctgtaacttcatggccatctcgcgatcattcatggcatcgtgggaaccaccatgcgctcctgcaaagctgacagactttttgggcttgcctccactggcgctatcgggtgatgtggtgccagagctagagcctccgatggccttgcggatgcggatgatgtctccctccttgacattgagccccttgagcacatccctgctcagctcgggtaaaatgctagcgtccatcttttcggtacggaaaatggtcgagtaccgaagggcgtcctccgtagccacgccagctttgatgaagaaatcataccagtcaaagcccgcttccgacaccttcatgccagtcatcttctcaacaaatgcgacgtcctcctgcgacatctcgcgaacagggactgcaatcttgacgccgttgagtttatgcagactgattttgccgtcatgaaagcccaagtactcggcttcgaccttgtattttcctgagcgatctgtccacattctggttttcgtgggttctgttcaaacaaagattgggccgagagtcagtgtttctgaggagtcacaaatggtcatgcccagtcaacgcatattggcacttacttttgacagaagactccgtggtagtaggagcagcggcagagggcgaggccgctgtgcttgtaggctcaatagccctgggaggaagagcaacaggcacagtttgtgatggggctaaagagagcacaggaaaaaaaggtcaatgaaggtgatctggtggaggactccatgcaagtaaggatacacccgtacaaatgcaccattcacttacgggcagggacagcgcgtgcctgatctggagctgattcctcttctggggcaggcgctggttcctcgtacgcctcttcgggcacaggctcgtctgcgaactaatattacgtcgcaagtcgagggaatataacggcgtaatgtcatggtcagcggaacaattatggttgaaggattcactgcagacgtactgaagacaagcacgcattcacacagttttttcaggttcaaaacatacctgcacgtaggatgctgggacaataccgacttgatcgcccagttggcacttccaccactcctcgctgctaacataatccgagacccagagctcatcattttccttgatgttgagctcctcctcggtttcagcctggaaatcgtacagcgcgatcgcccagcggccttcgcacaccggctctggctcaacaaactgctgctgttcctcttcgtacgctggttcttcctgcacagtctctggtggatacgcgacgcttgcctgagcaatgctcggcgacccttgggtggtgtgataggttgatgaggacgcaacagagtcccgcacggacggcggggtagcaacagcggtggctgggcgagaaatacgcgacttttgtttcgaatcctggatcttgttgaagatggcctcggcctcctgcttggatgcggcttggaagtcgaatgaggcaggagatgagcctccaagatccagatacacatgcttcttttcctgcctgactttgtcgacgtccttgattgaccactgacgcacaggcgactacagtgagagaataagccggcatttagcttccacctactttgtcgtttcaacactggctatgctatcggggaataaaagcaggctgctgaacatatcgcctctgacgttaccttgtcttcttcgctcccaaaaaagatggtcaggttgccaacaccaagactacccttcttcttcttctttttcttgtctacctcctatcgttacgaaaagagttttgaatgataggcaaaaagaggttggttgtctgatctgggcgtagacgctgggccattcgcctctactccagctagtcaagcacaggagaggcggcttacattaacagaccaaaatttgagatcatctttctctgcgggggctgctgctgctgctgaggaggtgctaccggtggaccttggagcggcatccgctactgggtcttcctcataagcgacttgctcttgctcgtgttgctgctcctctggctggtactgctcttcggcgtattcttcctgctgtgcctgctgtgcctgctgtgcctgctgtgtctgtgtcggtccatcatgtcctgcagaggcctgcacattcagttcagacggaaaggaatatcagagacaatgcatagcttgatgctaaggcttccatgctaatcaaagggcgcacagagttctcgccaacgtacctcgacataatttccaggcacgaagcctacgtgggctccattgccaacgaggaaccagtcgggatcgtcctgctcgtacaatgtgagcgtgtcgccctcctcgaacgagagctcttcctctgtggttgcatcatacttgtatagaccgacaacggtgccactctcggggtgctatttttgaaccaaaagaaacgacgcaagtgtcagtgggatggggtcctgcttccattattgttgtgtccgtcctgggtttctctccccgtgtttgtgtcttcctttttgtgggtacgtagagtgctttcgggctggtgcgcaagagttgcagcggatgatcgccatccctgaatggcagagttgggcgtgaaggtcgaacgggcagggattcaaagcgagctccttactggttcgacgtagttgctgggtataagaccgacttgcagctcgttggggtcgacagtcttgagcttggccttccaccattcggggtcgtcgtcctcaaggacatagaggatgtcgttctccttgatggacagctcctcctctgtgttggcctcatagtcgtataaggcctggcagaccctgaggaaaggcatggctcagatgagagacggggtgatgagaaacgggcgggggatgcgacgagcgggctgtgtcagaaaagagcgagggagagagggcgagaggtgctttgctgttgtcagtcagagcggatcgtcaatgacagtggggggatgaggaagaggaaggtgcggatggagaagtaaaggacagaggtgggatgaggtaacgggagaaagcgaagggggttggagagtgaaaggaatgaaataagacggaattgatgcattcagagtcgaaaaaaagaagacccgaatgacgggtgggaatagggcgcaaaaaaataaaagagagcgagattgctttcgcgtgtggtcacgcacaactgactgacatccatcccaacactcccacagcacgcttgcttgcttattcgccctctctctctctctctcgccctctctctctctgtcctcctcacacactcgctcctctcttctttgttcagcctgctactgcacttctttctcgaatcgataccctcactctaccgtacagatacaccaccactttgctcagactgcacacaccactcggtcccaccaccctcccactctttctcaccaaccccctcgagcaaaggccagccagtgagcagtcagattacagagaaagcgactctcgcccgcgtcaagttttgtgtaccacactcgcattctgtgcagagtgcgcgcagctatttttggccacaggcttcatttttcaaaatcccacttttcattcacagagcccaaaagacgcgttattgtgcagtgcctttttatattctactgtcagtctaattctttttgttctcctccttgggcttgtcatcctccaacaagtgctcccagccatcgtccaaaggcttgggcaaggctggatgttcggcctcaaactcctggtctttgctggccttgtccttctcatcctggtcctccttggtctgcagatctctcgcgtcctgttcctccttatctctcttcccttgatcctccggtgacggatcttccaccgtgatccagtgctttccctcctccttctcgacccagatactgacacttcccgaatggcagtggaacttggcccagccgtcctggttgatagtcactgggtccttccagtagcccatcatgtcaacccacacctgaccagctttgtccttacccacatccatcttcttgaaacccgactctgagttcgacatcaccacagccagtccatgtgggtgatgctcgtctccaaagcggacccatccgacacagttgccgtggtcaaagtagtccatttgaggaccataggcaaactccttacgggccagcaacacacgcgagaacatctccttgcgaccttgaatggctgtgtgtggctcctcaggactcttgggctcaatgccataaaagtcgccatagaagagacatgggtagccatcgaacctaaggcagataagctggcaatgtggaaaaacgatcgtgtcagtctcatatccgagtggttcgttcatgaaagcaccgcaaaaggtaatgaatgacatattttgctgacatactgctgctgctaaaggcttgaaccatggttcgacatagctctcgagatcctgggatggctgggtatcgtgattgtcgataaaggtaacggcgctctctggagacgacctgaccaaggtgccatcaaagaccgttctcatgtcgaacgaaggaccctcgcgcccagcacgcgcaaagttgaagtgcaatggaacatcaaacagatgaatctggccattattctcgagatgagagtcaagctcgttcacgtcctgcttccagtactcgctacacaggtggtgaaatgcgaaaagtgaaaggtaagaatccacgtcattatcctctccaccaaatttccacttgtgaataaaaatttgtgacataccctacgcagaaaaagtcgggattgttgctctctttgcgcacatgggccaggagatgcgtgatgaacccgaaactgatatgcttcaaagcgtcaattcgaaatccatcgattccaaattccttgacgcaccttgagagagagagagtgagagtgaaagagttgttgtacacgttgccaaggggttagtgcatcggacatcaagcgcatttttgagcattcagtagattacgtcgatcagtgcttaccacatggcccacttctcggtttctgcgactacatctgggtgtttgtagtcaacatcgcagcacatcaaatagtcaaagttgccgttctctccatcaacatcctcggcaaagctcttgttctctccgatgattttgaatacagcctacgtttcgaagataacagttttagcaccaaaatcaagcagacactaatgcaatgcaatgcaacgcaatggccagtgcgcccgatattaccttgcggttgcctctggcatcccaatcagtgcctgaaaagtggtgatgatgccactcaaaatcagagtactttttctgcctggccgggaacgtgaactttgtgtaggcctcgatgtcatggggctcttcaatctcgcggttgcggtcatcgtcagccacagctacagccttgaagacctcggtctcgtcaccaccagccttgtggttcagcacggcgtcaaggtagatcttcatgccatacttgtgacactcgtcaatggctgccttgagctcgtctttggtgccgtactttgttggtaccatgcccttctggtcgaactcaccaaagtcccagagatcgtagggagcgtatcctacatcccattcggagctgtgaacaaaagcaagaatgaaaagaatgatttagccaggatcctgtacatcacgcattaggtggccgaaggaaacaagacaacacagtatggacgtaccatcctttcatgggaggtgggatccaaatagccgatagaccgagagagctcagcaggctagcctgttccttgaggcggacccaatgcatcctgtctacaaagtgtgcgcagcgatgatttgttagttcgttttcagcgatcaattgatgtttctaaatccagccttgcgttcattcgtgtaaacccacctgcaggagtgtaccattcaaagaactggaacatggtgatgttttcgtgttcgcctggcatgatgttgagttttagcgtgcagtagcgcgatggggatggagtgaaattaacaaaaagagtaaggtccaaaaaaaaaaaaaaggacgaggaggttatttgatggatataaatactgcttggaattgtaacagcgtatcagctgtctgcagtgcactcacatcttcttgttgtatgatctaatatagaccgattacaccgattgcacgatccttgatgacagcagcctagaaagaaagaaaaatctaatttagaagaggcacggatccgcgacgcgctcacgcacttttttttgatttggtcatgtcgtcacaatgacccgctctcgagccgcgtacaagttcgcaccaattgaaatccagttcagcgtacctcgttcctgtagtggagccagagcgtcggcggcattgttgatggacatcaagcgtatactctttctcgagttgatcatcgacgatggttctaagggcttttgttgaatggaagtctctgcgagtgatcagtgccatggttataaatcgagctcaggccagcgtggccgacggctgtgcgattgaacctaacgaactgctcctaacgcaacctcacgaacaaaaaaaaaaaaaaaaagacgatgctgcactttgtcccgtcactgcgcttggtgtttactgccacggtgacgctttttcttctgggatgcggcttacctatacccatccgcgcccagtccacaacctcttcgaacaccgcagcgtctagtggtcgccaggtccagtttccctcgaacgtcactgcctgcgtcgcttgcaaacccgcctttgccagcgcggcctgccaaaccattctagactcgattgcaaagtcgtccttgacacccatttcgaacagcaccctggccagctgccaatgcactggatcgttcctgtcgctgtacccggactgtctgcagtgcttcaaggagacccatcagctgagtatggtcttcggaggtaacaaggctcccgcattagcaaatctagaggcttattgcagaacgttgccctcggatcatgacgagtcagggactaggccgccagccaacccgaatttggccatgtctctgcagcgtggactgaacgagggtcagcgtgttgttatgacggtcgcggttgccgctgcatgtgttttcatctgcacggttccgtagtgccaggcatgttgtatgtgctgtagactacttactgtacatgtgcatgtacgctacgctgaggggcacagctcttgtttgcagtaaagttcgatgccctcactggaggtcgagacttttaacactttatgatattattcaaaggaacccgctaatgttggtggttcagttcctaactatggcgctatggaggggcagttgaatcggggggctatctataagctaaactaagtgcctgtaaaggcggatctgtgtacagtgaaatctcgtttttcggtcacttttctcaagacgaactgaccgataactttcgctggactgaattgatttcctctgctatgtattcaaaagtgggtcaattgatgtgtcccatctgatttttgcctcaagccctctcaaatttttatcacagccccctcaattttggccagaatttgggcagcggcatgtcagctgactgaaatttttcagtttttgaagtagaaatcaattcattcatggcaaaaaagatatcggtcactttttcttaagaaaagtgacctaaaaacgagattccactgtacccttcgagggtgagaggtcgaggacggacggttgtgcggcaatgcagaggtggccagggaaacccaaggaaacgacgaacttgcagaaaaaaaagtcaaatcatgaagtcattcgggatcactgaaaccaagcacccatcactatgagataatttcgagcgatgcgcttatgggcgtatatatattttggctgctggctggttgaggatgcatcctatccccctttccctctccttccacgctgttctttcctctttacttttgcgtttacgctctctcggacaccttgcaccacaccacctcagacacacacacacacacacacacagaccatttgtatctgtcctttcctcacaaagagcacaacagcagcgaacatcccatcccccctttttccactctctctcttccttctgcacattttcccacacctcgtcctattcatatcccagcaactccacacacatcgccaccatgggaccagcagagaccatcagcacacacaccgtcaagaacgacgccaccaccaccatcgtcacacggaccaccaccatcgtctcggagcacgaggaggtgctggccgagccaaaggagcatggccacagcgtggtcgagaacgtcaggcagaccctgcgcgactactggttcccctcccatgcgtccgaggaagaggacgacgagccagaagagccagagccacaccaggatccttcgctcttccgcggcaacagtgtcatgcggcgagcctacgactactggaagaccctcacccaagacgccgatcaagctgccaaggacatggtcattcaagcaaaacgcgctcgcgacgaggctgccatcgaagccaagtgggcctatctaggctacaagaaggaggcccgcgaggcttatgaggaggccgagaagaaatacagagaggctctcgcctttgcggagagggttcacgaggaagcccacgagaaggcaaagtcaaagtggttccaggcggtggacacgacagagaaagaagtcggcgagattaaggatcaggcctcggaggttactcacaggaagtgggaccagttcaagtctgctgtaaactccatggctttcaacccgcccaagtatggatgcagcccgagctcccagtactggttctcgcgtcagaaccctgccgctgattctggatgggactgccgcgagatctgggaccatcccagccgtcatgaccacagacatcacgctatcaagaccctgcccaagaagcacctctcgattgacagagtccacgacaccttgacaagtcttttcacgcaagcagggcacaaggccagaaacgccccctcggctacgtcattcgaaacgtatttgaagcccgtccgagaccagtaccaccgggcgcttgaccgtgtagcccgcaatgaagagggcgctttggaggagctcgatgccgcagtcgacaagatcaagaccaaactgaacgaggcaaagtactttgaggagcaaacggacgcctggttgacctcacagtggaacgcggtcatcgacaatgcaggtgacaccaaggatcagtacgagcgcgtcttcaagaacgctctcaagagcatcaaaaacactcgcaatgatatctacaataccctcctcaacagcttgcagcgcaacatcaacttggcgagaaacaacatcaaagaggccgtccgcgccaccaaggaccaagcagacaagtctcgagttcacaaggccatccaagatgcttcggattccttctcgagcgctgtcaaggaagctgagatcaagatcaaggccgcgcccaagcacgcttacgatcatgctttggacactttccaccgtgacaccgctcaactgaaggccaagctcgagaaagctgcctccattgcctcaaaatcggcttcgtcggtctcgcatcgcgcatcgaaatccggctcgtccgcctctcatcacgcatccaagtcgggcgcctcggttctccatgaggcctctaaatccgcatcctcgctttcgcatcatgcgtccaagtcgttgtcctcagcggtcaaccaggtcacaggggatgccaagcactttgtcgacgaggcccagagatcggcgtctagcaaataccacgaagcggcggacaaggctcgtagcggatacgagcacgccaccgcctctgccagctccttgtggggctctgccacgccacactcgactctccacaaggttcagcactcttaccacgaggccattggcaatgttcattcccactggtttggcgaccacgttgacaacgagatgagcgtcagctcagtctatggagccctcctcgcgatttatttcctcttcctggctaaccgcatctggcgcagccggcgattgagtcgcatggcggaccctagcgaaaagacttttaacgtggtcaagaacggacatgctggagatactgttggaagcaacaacaagcatcgtaaatcactcgttctcctctctaggatgctggcatgtgtacatctgtgcagtatgaacccagtattaactataaaagcgtcttgttttttgatagccgacggcgagtatgctactgccaccatcgagacatacaagcgcaagtcgagtgctgaagagacgctggagaaggagcgcaactcgtttggcacggttctggttcagttcacatcggtggttccggtcacgctgatcctgctggttcttttggagctcgctggattctcgagggttgcgctgcacacactctttgttggacttatcacatctcaggtcttgcaaggaggtttgctgaacgatatgctgaggcagatgggtattgttgacggagtccatgcctctggccgcgacattggcacgtacctctcctgggctgtcctgggtctcgcagctgttgccaacgccatcaaagtcttgcacaattaggtacaccaggctcttctttccaaagctacttgcactcgcgaataaaaaagcattgcagtaaaatgtcatattactcaagcaacactttccattcccaggtcatgactgacatctgcgatcaaagtgagcaaatattttttctgctcagccaccctcacaacttctttctttttttttgctcgccctgttccagtccgtcgcgttcacatttcttttcttcacacttttctttttttttttcacccagctcatcatcagccagtaagtaatttgcgagactaaaccagaccaggcgagaccaaaccggactagactcaattacactagacccgcatcgcactcacaactgcaaggagctgttgaacgattttggagatcaggaactgcatggactaccaagctcacaagacagctcagccgacttcaaaaaaataaccagctactattcaactcatagattttttagtacatctggccatgtccaccaaaaccttcaccatcgagggccgcggcctcaagctggattcagctgcggatgtgcaggaattcatcgacaccattgccaagatggacgagctcgagaacgtcatcttgagcggaaacacgttcggtgtcgaggcttgccgtgctctttctgctgccttggctaagaagcctcttttgaaggtaggtagccgagagagaaaggctgagaaaggagaaagagagagagtgagcgagagagggagtgagtgtctcgggaggacggggaccattgttgaacggacaccgtctccgcaacataccacataccaatacggacatgagaacatgcgattttcaaaccatgtcttatacgtctgacgctgacacttgaaaaaaaaaaatcacgttctcgtatgtgatgccttgatagctcgccaacttttcggacattttcactggacgacttcgctcagagattccggactgcctggttgcgttcggagacgcgttgaaggacaagaagcaccttgaggaactcaacctcagtgacaacgcctttggagccgctggtgttgtgcccttggtcgagttcttgaccaccaacaggaaccttcaagtcctgaagctcaacaacaacggactgggtgtcactggaggtaaggtcttggctgaggcactgatgactgctcatgagaagaacaaggccgagaacaagacttcgtcgcttcgtgtcgttattgcaggacgtaaccgtctcgaaaacggatcgacgcctgatcttgccaaggcctttgctgcccacggaaccttgacgcacgtcgctatgccccagaacggaatccgcatggagggcattgaggccctggctgcaggactcacgcagtgtcgcggactggaaattctagatttgcaggacaacacattcacagaacgcggttgccgtgcattcgctgcagctttgccatcctggtccgagttgaagcgccttaactttggcgagtgtttgctgtcgaacaagggcacgatgttgttgtcgcgggccctggcgcagggaaagaacacgaagctggagtctgtcgacttttcgtatgcagagatgagagaggatggtgtgttggagctggctgctgtgatttcggagcacctctgcaacctcaccaagctcgagctgaacggaaaccaggtcgaggaggacagcgcgtcgattgatgccatccgcgatgctctggccagacatgaccacggcgaggcacttggagaactggacgacatggaggagcccgactcggatgaggatgagagtggtggttcctcggacgaggaggagaaagaggaggaggaggagaaggaggaaaagaaggtggatgatgaccttgcagatcttgcggccaagctcaaggtataataagccctctaaattctccctcccttcccctccttttctttatctttcctaggccgagcctgagcctcggtaccatcgtagtcattctctcatacccttacacaccaccttatagttttctcttgcttgcttagatcgattccccccttccttccctacacatgcctcaactttaaaagaaataaagatgctcggatttaaatcgaaaatggcgcgtcatcgcagcacgttatttccctgcctccatcgtgggaaattttggtgctccactcccacactctcctccacgccaacgagataatctttttttttttttttctccctgctcctgttgcgtggctctttatcccttgttgcactcactgccctctttcgtctctctctttcactctttcctccgcaccctccgcaccttccccactctcctctgcacatccgccggcactcctctccaccgtccacatccctctccactctcgtcgcgcccgctcccatcaactcgcctcatcgccatgtaagctcatcctccatccacctagaccccagcgcctctcatccgcaattgtcccacgggtcatctgccatcacacggctagttgcagagtcttacactcttttcctagcgccaccagacactccagccttgacaccacagcagaggaggcagcaaaaccaacagacttgtcactcaccaccactaaccgaaaacgacgctggtcgtctgcctcgtccccctagatactgagcacctatcacagccatgttcaccgcctctcgatcctccctgaatgtcctcaggacaaaggtaagaacagctttgcatgagccacccccaagcaggattgtggatcgtgcggtggggtccaactcgcgcaatctcagcattttgacaaatgtccgccttgttcgttgttttctcaggtcggccagtccacatacatctccaccgctcgcatgatttcgggccagaggctaaagtactcgatcagtaccaaggtgagtctcagagagacaaagggcaacaagacacaagaactgcccctattttgatagctctgctgtccgtatcgttttacgcaaccggggtgcatgtcatccttatgctcatactcgtgctctggaatcttgatagaccacaactgccctctgcaccaaggcaatccgtcatcagactgtctttggagccaaccgcgtccagagattccacgcttcggctatggctaatgccaaggtccccttcctgcttgctgatatcggagagggtatcactgagtgcgaggttatccagtggtatgtctttgaagcattgaatagcattctaaaggatcaatggattcgttggggactgtgacgacaaaaggtgttgcttttacgtaaactaacgatcaactatgcttgactttgcttttactcaggtttgtcaaggctggcgacaaggttgaggagtttgaccgactctgcgaggttcagtcggacaaggcatcagtggagatcacatcccgattcacaggaacgatcgcctcgcttcagtacaaggtcggcgacatggctagggttggatctcccttggtcgagattgagactggcgatgatggtgttgttggagaggccgttgccgcgcccgacgcaacgtcggcctcgactcctgcccccgaggatggactggagggccgttcgcatgttattcaggacatgaacgcagtcgccgccatgatggaggctcccaaggctgtcaaggccgaaatccctactgccgagcatctccttacattcgccacacctgccgtgcgtcgtgttgccagggagaacaacgtcgacattgctttgatcaagggatccggcaagggtggtcgtgtcatgaaggaggatgtgatggcttaccttgccaacggaagacagaccactggtaggtgtttaatttttttttgtctgccagccggagattttgctcaattttttttttgagcgggcaccgcattttttttcccacgattcctgacaaaatattttttttcttttcgcttcatataacagccacacccaagactgagagcgcgccagctgtttctgccaaggcccaggtccccaagggcgaggacaaggtcgtgcctttgagcatgatccaaaaggccatgttcaagcagatgaccaagtcgctgtccatcccccactttggattcgcggacgagatcattctcgacaacgccacagcattccgtgctgctctcaatgtccatgtggccaagacccccgaaaagtacaacttcaagaaggtctcgtacatgcccatctttatcaaagccctctctatcgccctggaagattaccctgtcctgaatgcctgcgttgtggacggcgacgatgcgtcgagtgccaagctcaagtaccgtgcttcacacaacattggtgtggccatggacacccccaacggcttggtggtgcccaacatcaagaacgtccagaacctgtcagtactcgagattgcctcggagctggctaggttacaggaggccggcaagaagaaccagatccccatggctgatctcagggatggcacactctcgctgtcgaacgttggcatgattggcggcacctacctgaaccctgtggtggtcacgtccgaggtggccattgctgctgtgggcaagatgcagcgtctgccccggtacaagatggtggaggaggaaggaaagatggttgagcgtgttgttcctcagacgattgtcaacgtcagctggagtgccgaccaccgggtcatcgatggcgccactgtagcccgcttcagcgaggcctggaagtcggtcattgagaaccccttcttgctcggcggcatgctccgttaagaaagtcgacggaaatataatacctggtgagggaggaccgaggaggggagggatgggaaaagtacatatggttgggtcagtcatggacaaaaaagaaattgttctttgcccctgtctgttgggaacggatgcacgaaggtgggctaaatgatgacagccttcggagcaaaatatcatcttagaacatcattaacaatatacatgagaacaaaaaaaggaaggaagtgcccagtttatttttctattggcgttgtgttgctttcttttctatcatctctactttacgaaaaacttcaaggatgccaagggtattgagcgaacgtgaacatgctggaaggatccggtctctgcagaggcatgggtagcatagcgagcatctaaagtgtgatcgcgttcgtgatcattaggcgccagatagtacacttctttgacattcatctgctgaaggtactgcttcaactctgggttgtagaacatgccgacatcgttgggtccatgggaatcgtccgaaagcgtgattcgaccgtttctggacaggatgtactatgaggaggcggtgaaaagtgagaagacgtagctctattagcaactgtccgcatggcgattctttctctcattcacacatacgcactctccatctctctctttcaacgtctgctatcatacctcgagtatatcgcgctgggggtaagcgtccgctagacccttcttccaagcgcgagagttgagttcgaataagcctccataggcgatcacaaagtcgacgtttctcttgaccaacgtccatagctcctctgtcaatcgattgtcattagtgtcgattccttgtccttgctcttgctcctggtcatgcacatgcgcatgtccatgcccgtgctgatgtcccttgatagctccgaaaaagatgcgaactagatccaaatgtcctacgacctcgggttccagtccttgaagcatctcaaactgggtattgaagtactctctgaacaaggtctcccatgatccttggcccaccacgtccagagccttgagatacagctcctgtgaaaagtccagtggaatgttgtggacgtgatgtagcgatccgacaatgtactggacttgtggcagtgacaccaccccgagcgagttgttgttattgttgttgttgatgttgttaagtccttctgtgccagagctgatcgtcgttgttgtcgatgccgtcgttactgcagctgctgggatagctcgggtctgtcggagtcgttggaccaaagggatggattgagcatcaaagtactcggtctcgagaccgatcaacagacagatctgggaggcgtattgaccctggaggcgatgggcttcttgcagaaagtcgtcgtacatcttttccaagtctgctactgtcaagtgcgcctaagaaaatagatgcaaggtatggtgttcagtatcctcttccgatctgctatggtatgacataaaaaaaatgtgttgttgttttcgcacacctcttctggatagagctgctctggcttgtagcggggcatgtgctctgaaagaccataggtggtgaagttacgttggatcgcggactggaccacttgctcgagcgtgcccgtggcgtgcatgcagaactggcccgagtgtgaatggaacgaaaacatggcactcatggcgaaaggattgggtgactcggtggtggtggtggtagagaatgaggtgaagattaaagacgtgaggagagacattcgtatcatagagtcataccaactcaaacgcgctggtacagttcgtgagtagtcacgaactgtaccacgacacttggccaaccttgttcctctcacattcgttgtatttattgtccatggcaacatcaaaccttagccagcgcacgcagagtactacagcatgcagcaggagctagcccaaaccactctcatggcaaccttgtccccaatgcgcatttcatcacctctccgtggttagatcagtaacgttgccgcggacttcgcattcaactctgctccaaactcagttcggctccacgcgcttgcacaatttgctgtacgcggccagatctcgggaaggcggcagcagaccactgcagttgtctcgacaagctactgtagcatcgtgtgctcactgtcgcttgttgtgggcatattttcatgcacaggaatgttggattgtcgtcaggaaagaaaagcgcgcggtccgagttcagatcgagaccacatttttgcctcccttctccctcgccttcgccctgctcagcactcagcaccaccctcgcacttttagtcttttactcactccttatccctgtctccagagtcatcctgagaacagcgatggaggggacacaaaccattcgcttggtcgagactacggatatcgtcacaatcacgctcaaccatgttgaaggacagcacatggtttattggaaagacgtcgagcaagccttccgtggagtcaagcgcgttcgcaacggcaattcagtgatccagcttactcgcggctctgattcgcaaaggtactaagaacaaaatgagttgagacaaatgttcttgaagagcaagcagctcatcgttctttattctctcacctcccaatcataccgtagccctacctcggtccttgatgttgtcttgacgtcctctgtttagacctgatagagtcaatacttccgaagttgactctatgaacgtctcaagactatacatcagtaaaggatagagtcgtcgatgatctgaaagtcgcccagccttcgaaagccaagctgttccaacaggttgtcaccccgtgcatccaagaaggcgcacgagtccgaggtcgagcagcgatttatctccctcttgccacctgaaagctcaagaaacgatacgtacctcgtcggatatctgccaggcgtttttcaaggcgatcaatggaggtgacggggagctgagtggagctgagcttcgacaagatcgccggtttcaaaagctggaggccatgatgaccaggaacacagagctgcaggaggtgttgcttgacaagcaggaagaagcgaaccggctgcaggagcaagtccttcaaaaccaggcagaggtgaagcaaatgcagcaacaggctcttgctcagctggttgtgcttcagtctcgtgtgaaagctgtcctgacgcagacctacgagctgcgcgagtacccgatccctcgactgtttgttgttctcccgcaagatccctcgagatgggactctgtgaatgtctttgcaaacaagttccggctgtactttttgtgcgagtgtggagaacacacaaagtcgatcaacagcacatccaagatccctcaccacatcctgtggcatgcagtcgtggctccgtgagggtgggggtgcacaggcgcgaagacagcgtggatgagggctgggcgcaggagtgaggacggcaacacacgtccagtcgcagttaagacaatttttttttctaccgtctttcatgcgtgcgttggtgtcaccctgatgtctctgcgcacgctcgctttagctcgtcacgccctcgacttgtctctctttactctttttgcccacactcgtctttgcactctctgtctccattcccatcgccaccatcacacacacactcctgtcagcacactccagccaaccatatccgtcactaccactgcaccatgtccatgctccgcttcactccacctcgcctcgtggcatccgcacgggccgcaggtgctgcgcccgctgctgcacgcttgcctcactgggctcgacacttttctgggtaaacgatccttgtctgtacatcccacgagcactgtcagtagcatggtctcgtcccatgttctctaaccccaccctctatcacaccgcattgatccaacgctgatggaccatcctcatcgatcgcatatagctcctctcaaagtatgtacaaaagtttttttccatcaaaacgcggcgttctcttgggctcattgcttgttcagtccaactttgtcgcgcctgctgtgtagtgtgctttagcgtggacgtggtggtgtgaaaaaaaaaaacacaaacgtcgtaggcgcatagataacgcgagggcctcgctcacagatgtactgactaacgcccttgcaaaccttgcttgcacgtagaccacaaaaagatggatgtgatcaagagcgcacccggatggcaagaggaactggcctcggagagcgaggcctacgtcaaggccgatcgtgaacctctgccgagggacatccatgcactccagcacgagtctgtgaaggctattcaggagaagcaccacaacagcatggagactgcagcccagactctgaagcacgactttgacaaggccaccagggagttgaataaggaagtcaaaaggtttggacaggagatgggccagacgaaggaacatctcaagcatgggctcaaggacaagggtgaggaagggttcaagactatgaaggggtttgagcgcaaggctgagggggtcaagactcacattgagcattcagaggactcggtcatggacgaggtcaaggctggcgcacagaggatgaccaatttcatgaaggagtcgctggacacggtcaagaagaccgttggcctcggtgctaccaatggaacgtccactagcggaaaaggacagcatcaacgtggcaaggacatgcacgagggcaacatcaagcaaaaagtcaagaatgtggacgacaaggtggacagtgaccgcggtgcataaacgtcaaatccaaccgggcgtgtggtggaccttgattgttcatccttcctctcctgaagtgatcaaagtctttagcagttttgcaccgctcacaaaaaagaagtgctatcaatacatgtttgctgtattatgaaaaaaagttggagtgcagaatgaattaaaaggaccgaggtcatgctagatgtaaatatgaaaggttgggtgctatctcgaattgtttttttttctttctctcttaaaccatctcaaccgccatctccaccttcttgccggcctggttggcattcgtcttgagctccttgtgctggataaagaacgacgaaacaagagccagcgatgaaaaggccacacagcagtagaacgcaaagtgcaacgcccgcacaaaggttgcgtagatcgtgctccgctccagctcgccgtaattcatgatgtaaccataatcctgcgtcaccctcaagatgctctcgtccccaggaaaccgctcatgcaacgaggactcgagcttgttgttgaacaccgatcccacaatggcgataccaaagacacttccgagcgaacgcatgaactgcaccatcgccgtgactgtggccatgtacttgggtttgcaggccgcctggaccgccaaggtcgagggctggagtgtgagtccgataccgagaccgcagatgaggagaataaagatggtcgccacgcgaggagtgccctccacaaacaacaggcaaagagacgatcccgtgatgaccaggagattgcccatggcggggaagagaacgtaggtacccttcttgaggatccaaatgccagaggaaatcgacgtgatgacaattccaaagacgaaaggaacggtctcgagacctccgaccgtggctgactcctgcttgatgacctggaagtagatggggatgtagaacaggattccaaagaaggcaccgcctccgaagaagagcgatccataggtggcccagatgttgcggaccttgaacaagtgaacggggatgatgggctctgcagggatcttccactcgaccaagataaagatgatggcggaaacaatgccggcacagaggaggccaatgatggtgcccgagttccaagggtacttgctgccaccccagctcaatgccagcaggatcatagtgacagtgatgaggagaagaatcgatccataaaagtcgattctcttgaccttgtcgctgaacgagcccttgggtgttgggaggtcgaggttgaaccagatgaacaccacggagatggctccgagaggcaagttgatccagaatgaccagcgccaggtgacgtgatccgtgaacgcgccgcccatcaagggtccgatgacagatgaaagagaaaagatggctccgaggccgcccatgtacttgccgcgctcgcgcatatcaagcatgtctgagagaatgataaagaccatagccatgagacctccagctccaattcccgcaacagcacgaccgacgatgagcatggccatggacttggcccatccagagatggcggatccgatcaagaacataaagttggcaaaaagcatgaccgcctttcttccaaagatatccgataccttgcctaaaacgatgacaatggaaagagttgcgtagcgcaaagttggaaaaaaaatatgtcagtgcgctgcggctggttacatccctggttttttttttttggttttcggtgttgaaccacaaaattagtgccttaccgtaaaggggctggagagctgtggaggtcatcatgtacgctgttccgagccatgaaatgtcgtttaatgaattgtactctttggtgatggcggggatcgatgtggagacgatgatctggtccaaactggccaggaacacacccagagccagactacaaaggcgcagcatttaacacgaaattgcgtgagtactctgcccttttttttttttttttttttggtctttcctgttgatatgctgtccaacgaattttccgaagaggcacttacgctgtcataatcaaaaagaattgtctgggaggtggtttgtagaacattggtggaggagctgctgggtcgacatccacgtcagcgtcacttgatgaggtggcatctggcttttcattgcaaacggtatcttcgccatcgagctcatatttctgtttggggtcgtggagtggaattgagatggaggagctggaggtggtggggacgttgtcctgcttcttgagagaggcttctgtagccatggtgagatattagggggtggttatgaaaacctttttgaagtcgagggactgagagtaagtgtaatgggtaactggggtgtattatagaccagcaaaagtgggaggtggttggacaagtatttatatgcttttgatctgacaaggtgttgatggaggatacaaagaaggcaaaaaactttgttatgtttgtccctatgagctgagagggagcagagtggacacccttatttcaaacaaagttgccagcagacacaagacacagaacgcatggacgagcgcggtcaattcatttcgtgaacacaatacccctttccttggcacggaattatcggccctagggccggagatcccgttgaattgagatgaccagtctaaaaaaaaagttgagcgcggcggatgtggacaattgagggtgtgcgcagtgcgcctgctgcccgatgcgtatcgtccagcagaatcgcaaaaaaaataaccttgtgggattgaaactctgtttgttttttgctcgctggcgaaattgctcctcgagctctagccctttgaatttattttttttgttcctcgtacgcggtgtagatgaaaaaatcttctgccgggattatgatatgccgtagatttgtttatgtttggagatgtcctcttcgaatacaaatgcaatcatcgcacatcgagcactttttcgccctttatattttgaaaatccgcctcactccatgtcgtgcgtgtccctttttccacaccagatccattcaccacagctcatagtgcgttctcaacttaaagctcgataaacaaaaattctttccgtgcatggatttgtcgtctgtcactccccaacagggcatcctctcgaacgcttccactgcgcattcctccggtcctcaaaagccgaagcctctcgctccgttcttggatgtcctttgtgctgtgtatggcttcttcacgtcgggcgaacctatcacccctacaacgcgaaagttgcggtttacattttcagcgattgtccacatttgttcatttttccatttttccttttttgacactcaacacgaagaaggacggggcttgacgatggttgtagcgccgcagtaaaatagcaaaaaacatacatgtactatacatattcggggaaagggatttgccgctatcaacacacgggtcagttgaagacgtcaacgccaaaaagaaatgcactgggaaaacgcgactcatattctgtgcaaactttgtaccgacgttaaacgccatcgcggggcgcaggcgctgcggcaaagggacaaacgcggctgttgtctttagacgtcaaagcatgggctgaaccatctccagacaggtgaactgattgtagtacggccgctaatggtttcaagttgctcctcccgcctcaataggatttcgttttttttttgtatatctttttatcgatgagatttattaagtgaatgccagaattagagtacaatgaatggtatgagagggagcagtgcttttcttatgcttgtagaagaaaggggtgaagcgggaggggtttacgccatttcgacagtcatctcaggcttttgctggttagcattcgtcttgagctccttgtgctgaataaagcagctcatgatgaacgccaacgtcgtgaacgcgatgctgctgtagaacacaaagtgcaacgcatggataaagccatcgtaaatcgtgccccggtccgtctcattgtaattcatgatatgcttgtaatcctgcgtcgctttgaggatcgtcgggtcctgaggaaagtgctccaacagggtcgactccagcttgttgttgaacactgaaccaacaatcgcaataccaaagacctgaccgagcgagcgcacaaactgaaccgaggccgtgaccgtggccatgtacttgggcttgacggccgcctgaaccgcaagggtcgaggcctgcatcgtgaatcccatgccgagaccacagaccaggagaatgaaaatggaaaccacacgcgacgtgtcgcgtacgaaaaggacacacagagctgagccgacaatgaacagagcgttgccgagggcggggaagaaggcatacgtgcccctcttcaagacccaaataccagaagaaatggaggtgatgacaattccaatcacaaacggcacagtctcgagacctccaaccgtggccgattcttgcttgatgacctggaagtacacgggcaggtaaaagaggattccaaagaaggccatgccgctgaaaaacagggagccgtaggtggcccagaggttgcggatcttgtaaaggtggatggggacaatgggctcggtggggatcttccattcgaccaagacaaagatcactgccacggcgaatccggcgcagagtagaccaatgatcatgcccgagttccattcatacctgccaccaccccagctgagtggcacgaggatcagaataacagcaccgagaagaaggaaggacccataaaagtcaatcctcttgagcttatcgcggaatgagcccttgggaatgggaaggttgaggtacagggagatgaagaagatcgaaatggctccaaagggcaggttaatccagaacgaccagcgccaggtgaggttgtcagcgaaagcaccaccgagcagagggccgatcacagaggagagcgaaaagatggcgccaatgaacccaatgtacttgccacgctcgcgcatgtcaagcatgtctgagagaataatgaagaccatggccatgagtcctccagctccgattccggcgacagcacgaccaatgatgagcatgttcatagacgtggcccatccagcgatggcagatccaaccaagaacatcacgttggcgaaaagcatggtcgcctttcttccaaaaatatctgataccttgcctagaagaggatagaacatgaaaaaatgggaggcgacgggcatcagtaaggagcaattatgacagtatcttgtggagccagaaagcagacgggttatcttaccatagagaggctggaaggctgtggaggtcatcatatacgccgtgccgagccatgagatgtcgcctaaagacgtgtactcttttgtgattgcggggatcgaggtcgagacgatgatctggtccaaactcgcaaggaatacgcagagtgagagactaatgaagggtaaatgttgtagtcagcacgtgtgcgaggggcgccattttgtttatcaggggcgggtaccggtttggtagagcaaaggtttaacgaaaggggtgctgtataaagcgacttacgctatcatgatcaggaggaactgtctgggtggtggtttgtggaacattggtggtggtgcgtccgcctcggaggcagcaatgctttcgtcaacaggagaggcttcttgcttttgatcgccgatattgagggagacagaggattctgagacggcggtggaggacacggacatgccccctgcgttgtcctgcttcgattcggctgcgaaggccattgtggtactgaagagtgttgtcgtttgtggtgctgctgtgtggtgcttgattgagtgcttcgatgaggagcgatctgcgaaaatagtactgtaggagcaagtttgaggaaggccgaagaggagagtgcaagcgatcagttgaggagaaaagtgaggaggtagaggggtgatcggcccacatatttatatgtttggaagcgcatcgctctttttcttgtccgacagcggtaattggacctgcgtcccaccagtggagaagcatctgctgttgagcgacttttaatgttgatagagttggaggcccgtttttcgctggattggaaatgctgcttgtcgaatacttcgatcactttacgtcaggggacagccagacgtacaacaaacagtgcacatgcactcttcttgtcccattcaggaacatttcgagatcaaagcgcagcgtttttcacttgttgaatcgcttggctggtgtatacttttaccctgaatgccgactgatgcgtactgcgtatgagataggcgcatgtttcatcacccattccagaccttgctcgcgaccgcacgtagaccaacgattcggggcacatccgaagcaatcttgaatcacgacagatgactaaaatggcactttctcctccccgcaccgtctctcgtcttctccatgttctcgagcggggtgttaatcgaggtgtgggatgagtccaggtgtgggatgagaagctacaagtggaaaaccgccccacccttcggcaaattttacaaccgggcgaatttccttttccactcgacacccctgtctgcgcatctctcaaatctcccgttgttccttgatgcgatcgaactcaatacgtagtcccggctgttgatgcttaaatgtgccgtgcagcgcaaactcaaagggtcataagcaagctaaagccgagactgcagtcttatttgctgttgcacatacgctgggcgctgcatccacatgtagtgcttcgtccctcttcttggtcggtacacgcaattgccgactacgacagctgcggtgtgcagtcatcaccttctgtcatatcagagaggcggagcagggcgcgcagtggtagttatgtggttgtgcactgctctaacacggcgcaagatccaaacagggagtcagtcaagtcttggcttttgacagaggagagggacaagaaaaaaaaattgatgtgcaacagagcgatttcattttgcgggcgcgcgtctcacttttacccctgtcacgctacgcctccaattagatatgctttagggcattttgtttctcgattcagctccaactctttggactgcagcttggagcgccttacaacaatatctgctaaagcatagtctgaaaagccgtctccgtaacttgaagagcatcaccgtgcctggtattttctgaacagtgagttccttgtgcttgttcaaatgttgggaggaaacgaatcaaagcggcgaggcgttagacagtcgggagtcgagggaaactcactgtcattgctgacggacttgataatggagtattagtcactagagcctgagcgcatggtgccagcttactttatgacctggggaactgttgtcaattgacgaatgaacacctctgagtagacgcacctgcggctttagagcaaggttgaaaataaaagtccagcactgaaaggagaatggcccataggcatcacaggttgctcgatggcgcaagtaatgtgctctatgttggaccgcttgggaaaccttgggtcccatgcagtacctgcctggattatccgcctgagaaggaagaatatggcgcggggtggggcgatcttgaccgtatttgtacgtgcagtcgtacgtgagatagggtccgtataaagctgaaaaattttcgacctgtttgtttttatttttctcgcttgacccctcccttcgtccttcattcccctcaacctcatcatccgaaacgcgtccagactcaatcaagatcaggatcgaccagtgccgagtccaaaacttcgaggagcgatcgcgatctacggatatggctttccgttccgctagtgctggacttgtttgcactgtgttggatcgtctgatcgtgatctgatatggcaaccgttcttgcggatcgtcgtggaccccccccccccccattgaatacaaggtatgcacacgtcttattctctcccgcgttcacttgtgatctgcaaacccccatgcacgaagaaaaagaagagaaaagacaagaaaaaaaggcggtggcagacccaccccgaccctttgcttatgatgtatcgatattccgcgtctaaacacattatgttgattgaaacatcgtgccttccttgatctgaagcaacccacaaaaaaaaacaccttttcttgttttcgtttctcttgttcttcgcgcttgcgcttcgcatatgaaaaggctataacagagtcactaaacaatatgtgtttttgctctggtatttgtcagtttgttctagatacccccgttgctgttgaacaatccttggatcaaaggggtccgaatcatgtacatagaaagaagaaataaaggtaaaatattcatttagacatatgacagcacttctgttctttttgcccgctccagtcctttggaagcatcaatctgccgtggatgatacgcgattctgcaattctcacttcaatgttgaagaaggatgacaaaaaaatcacatacacattttacttctgaggcatcttctgacctatttcaatgactgttggagcggatggcataacacagcaaagaaagagagaaaagatgaactcatttcgtgtttactttttttatctttaggtatgcctctggatgactattgtagtagagaaaatgtatatgtaacgatactatggaacgaagaacaataaaaatgtcattgttgggccataaaaatcaaaatcatcgtgtgagcaaggtataatgtcgtgaaagaaaagagtggagttgtctggttgaagtgcagaacgtcttgggaagggtcgtgagagatgcgtggaatttaggaatgctgagtatatgctgagatgcgttttatgatacgagggtgcagtcggacttggggcggggcgcgagaaatcagaaagaaaaaaaaaagagatggccgcgtaaaataattacaggacctcgcggcacactttcaggcactccatgatccctttgatctggttagccagagcatggcactcctttggattctcagaaacctccagggccagccgatagagttctaattttgtcaggagcgtagccatcgtcttgtgcgtagcgctgataatcgcctgtatttccggggtcggcggaacaggaggcgcgggtatccggccactctgctcagagtggctggagtgagatgcgcctgcggtctgcgggtgatgtcgctgcgagcgttctcgatctgaagagttgtagccagaggagttggaataggtcgaagtcgggcgagacgcagacgaggcaggagcgactgggacgggcggcacagggggcagcgactttgcagagaactcgctgaccttgccaatcatctgcagatgcctctttgtttcctcgtcttcagatgccagcttctatcacaaaggaggatcaaataacggatcaaggttaatggaaacggatctattagataatcgggaactgaaattgtatcgtctgtacacctcccttgcctcacatgtaaacggggactgggaggagtatcaaactaaaaacgcatggggcctcaggcggattgttgcataaagtgcattcaacggcatatacaacttacatccatatcttcgctgatgcctctatgcaggatttgctgactggtcattccgaagctgggcgacatggatgctggtggaggaagtatgattgaagacgatatcctcccttggagggcaacagataccctggactgtccagggctcgataaaggcgacatagctctgaattgcggtgaggtagaggcagaggcagaggcaaatgttggcgaggttgctcgaggggcaggtggtagtgtggtgggaggtgctgggaagcgcgacgtagtgagtgagacagcactcgtcgcgatcccattcggtttcgccgcggcgggggtcgtcgatggagtaattgaatgttttccttgctcctgctcctgctcccgctggtaatacgtctcacagaccacacaatactctttcttttcgcggcttctcatcaaaggcacctaccaacaaaacgattcaaaaatattagagtcgagagcagttcttttgttttttttctggcactgcatgtgagtttacgactgccacagttgcacaaggccacggagtctatagggacagcatcaaaggcattgagagattcctccccaccgacttctccgatttgttgtggttatatcatcatgcgcgcaagcgacgccggtgcacaaatgctcagaatcccgtccccctcctcccccttcttcctgtctccagacagaagcagagagcaacgaatacatgccccatgcaaaaaagaaagcgcaaacagaacatctcgaagcgcaatattaaaaaaaaaagtttcggcacgggcgcgcacaaacaacacgagtatgcgcaggaaatgaaatcgacccgttatcatggtgtggatacattgcgaatatttctctttacagcaaggacttaccccaaaacacccagtgttagggcatggctcctgcagcatggtccagccctggagcatcttttcgcccatcaagcgggacgccttctcattttgctcctttcgcacttcgttctgcttgctttcatgatcactgaatctgtgaaccacttcctctgctgcgtcctcaaactcgtcatggctctctaggtccttctcatcctcatcctcggctggatgggtcgatatgagagcagtgtggtagcgtgcagtgtccacgtccgaacccttgccttcccagctggtgctctcatgcatgatctcagccgtgacctcagcattctgtaaactagtgtgtgcgtcggacccggacccaaggcctggaaggatggcactcgacgagggcggagttgggagtgtcggacgtctgggaggcggcgatgacgggggcaggacattaccctgcatcaccacagagctctgaggcgaccgtctcttgtcccttggattcaactttggggcaaggggtgagaagggaggtgaggccaacggatttgctggtggaggaggacctggcggccgggggaaggcgagactgtggcctagagggccagaaatggcttttggaggaggggcagtcctgggtggtgaaggaaggggtgtcgaggatcttgggggaggaggaggtcgcggaaagtcagccgcagtaggaggcggaggagctgtgaggggcggtggagcttggccgccaatgatgcgtccagagggtgagcggaaggcggccttgcgaacgccttccatggcggggtccaggacggagatgcgatggtttatgtgtggttgaggtcggtagggcccaggggcaggggcagagggcagaaccgaagtgggtgcgggcatggccatggtgctgagaagggtgttggtggagtcggttgctgtcagcggggactctggctcagactcgatgtcaagcagctgcagttcgtcgtcgtcttggtcctcggggtcgataggggggttgatctcgcagttgacgcagacttggttggtcgcctcctggtttcgcagcaacggggtctgtgggaggcaggtgttggatggaggggaatgcaatcgcgtgaatggcaagggaggcggagtggagagtgaagagtgaagagtgaagaggaaggggtgcggtggaagagcgcagagggagaagaggagtccaagaagtgcaagcaagcaagcaagcagggacaaaaaaaaaatagatgaacactgtcagtcggggcaactcacacgacagcacactaaaatagcaacaacgaaaaaaaaagcatgcgatgcatgtgctggggatagggcgagccccactctgcagcactgtgcatcgtctgagtcaaccgcaaactcgacccagggacaggctgcacccccacgcatctcgtctatcctcgtccgcatcgcccatctcgcccagagcgacaaacgggacacaacaggacacagcaggacacaaccacgcacgacattccccttggcccctcgaaaacagcggaatgaaagtatattattacacctgcacccaatgcccccttttccgcaacggccaaagtgagaaagacgctagcggaatgtacacgcccggcggttagcaaaaaagtatccgcacgcaagcacgtacgttgcagtcggggcagccatcgttgagcaccatctaaaaaggaatggcatgagagagcagccgtgcagagatatcgtttagcgaaacagaacaacgtgcaccagaccagcgcaaggcacagaccatctccacccaccaccaccccaaggcagaaaccagaacgccaattcttacccagcctttgagaatataactgtcttttgccaccgagaccatcatgtctaggtctggggagtgtccgagagcgtcaggggctgtggtggcaaaagcgttggacagagccaaaagccctggagcacttgtctcaagcggctgatccagctcttcgggtgtcatggcgagcatgagtgaatggttgcaacaacgaggaacagatggcgagatggagtgatgaagtgatggagtgatggagtgatctggcagtgcagcagcagacagagttaagagtgggtaaaagagagagagagagcgagagagaaggcgagcggcaggcgttattggcaataacgaaaacccgatataaaaagaaaggcaacagaaaaccttgtatttgtgccattacgaagcgttggctaagctgtacttccagaactgtgtcgccgctgttgggagataccccggccaacgtaaagaatactgtagttgacattctattcttgccgtccgtgtaaagcgatagaacggagagagccttcctcgcaggcttattgttccgttgccatggaatggacacggaggggccgctagactgccatacatgtatatatgtaggccccactacttgtctccacattcctcggagtgtctctcaccctagagttgagccctctcctccaggagaaaacccaagaggcgcagagttgagtgtcgcacccgctcgcagagcaaaggcaattgaaccgatctggtcggcattgacgggcgacaaagacaaagttcattgccttgagacaaggttgtgggaacggacaggctgtcaaaacaacgtggaaacctactctcgtctctagtccaggagacgtttgcaacttgcaggtcccctacctgttatctacatctgacgttacgtcggatacagcattgattgtctagcctcttgtttagagtgtttgaggctaactcttggtcccacaaagtacgagtattctgtacatttccatcctctgcaggtacagtacatcactttcgtcgtgatacaggtctcttctagaactgcgactttggcgagtggtccagccctttgaatatctgaccctgactgcaaaaaactgctagtgttttattactcgactgtgacagcaagaaccgagaaaatgcctgcaatcctcattccttccgcccttttttgcccaccattttttactcttgcttgtaatactgggtcgtagcacatgtctccgtgatcagctttgcgaaatcacccttctcggagcacccaaccgttcggatccctcgatcctccaatatctggcgcaattccttgggtcgcatctgcatcagttcctcataactctgtgtaatcaccggtaaagccacaggctccttacgcgtcgacgaagccttggcggcggcctcctcgagcgcctgtccaaacttgggatccatgggatgacccgaaaacacaatcttgttgttgacaattacggctgcaaagggaatccccgtcgcgccactgggcttgaacacctgagagtgcaacgactggttcttgtccatcaccaccgtgtactccatcgactggttcttgacaaactcccggattttctaatgcggtaaaaagaagggccatgatgccttgttcgaagtttgctacttggatggttttcatcaatccatttgctggagaaaaaaaaaagtcgcgtgttttgttgatacctgctcatcctgctcgttggtcgttcctacgatgatgacatccacgtccttgtacttgcgctggagttctgacaagtgtgggatactatggcatcatattggataacctcgaggcggagatcagtacacaaggagcaagcacatcggacccaaaacgcgtcatccatgttaaaagaaataaacaagtctcttcgccgtacctttgcagacaaggtccacaccaactgcggatataatccatcaagataacggcagagaagccatgggtaaaaaaaaaagaagaaaaaaaagggaaaaagggtcagagtccgttgtgatagagtgcaacgtacttttttcttgcgcttgtggtatgcgtgaacaaaagataaggacgcatttacgtggcccagaactcaagcacgacgactttggtgcggccttgaggaacgggacctccgatggtgacggagggatcgccgttgatgaccaaaaagtcgttgatgaacgggacttcagagccgacagacatgatgttggttatgaatgacttttcttaagatggagaaaaatggactcaaaacgtttgagatcacctgactcccatcttgaatttcacttttgcttttgagaaacgaaacatgtccacaacacctaaaaacaaaaaaaaagctacattttttttttttttttttcgcttggaaaaaattccttacatcgtgaaagtgcacagtacacgtatgtacaacgtcgagcaaggcttggggggagtttttttttattttatttggtagtgcttgtatagatggtatgtggagaagggggtatcaatgattgatattacagaaaaaaataaagagaaaagaaaaagaaaagtcaagaaaagggcgctggtgcgtgcctgaaagggaaaggaaggtgtagtagtagagtacgaacagatgcaaaaatgcggggtggctattgaacagggtgtgtgtgtatatatatatataaagacattatgtaaaaaaaagaggggaagatgatataaacgctttatcgcacagcgacaaagtggttctggtaccaagcaggcgaagaggtgggcgcggcctcagggacggagacaatgctgccgttatcggggttcacgatgggtatcctggaggccatgcggggtggcgagtacgagtccatggtgggactggtcattcccatggggtaggcctgatgcgagtgttgataagggtacgagccatacatgctgttgaacagctgttgctgttgctgctgctgctgctgctgctgctgtcggcccaggcttggggtaatgttgaaatatgagtccgactgcgactggggagccatcagtccagctgtggcaggggtggtcgacccagagtagcgaccagcaccacgagcaaagctgttgctcgaggactttacagtggtgctgggggggatgtacaagggtgtacgactattggggtccacaatggaaatggctctggagccagggttcgtaggactagtgggagaagtcgcggtaggagacggtcgctgttgctgcaactgctttgcctgggtctccttttgggcaaggatggacgcgaggatgatctcagacaactaagagacggagaatacaagaatacgtgcgttagcgtatgcttttagtcgcaagtctctgtgcgtctcactgtagcgcgagtttcggctggaccaacacacggctgacggatgcgcaacgtggtaaggaccatggtaagtccacgcggcaactccttttttttgtgtttggtgcggagggcaaaatgatgctgtatgatataataaacaagcctgagcctgcacaaatgcactcatacacaaacaaaagaagaggaaagggacacatgcatcgggctgcatacgctccgaagaccatgagaaacagagagggagaagggagcgagggagcgagaggagatgagaaacacacaaaagaaaaaaaaagataaggcgtgcatgaatagggagaggagaactgcgtcaacagccatgcagcagagtaataactcttgcgcatgggcgtcgtgcgtcctcctccccagcccaagcgtctggccatcctgtctgctctgtgtgcggtgaccccactgcccccgccttggttcattgagaccgaggagagacagatacattgcgaagggcgcatatccttctaccccagcactactgcttattttcgcgcccctcacaatagcactgctcacccatccccacaagctcaacggcgttgttggaaaacaggtaccgcgccttcctgtttttagccgcgtatttcttttttttatccgtgagaagaggttgagagtggacaggggtgagatggtactaaatatacaacggtcgccttacctctttggcggtcaagcttgggcaaaagtcgaggtcatcgtcgaagcatcgagcagcctcctggctgaggcgaaactgttcaaggtgcattactattgagaacgaagcgcaggagaacagagtgtgagtgtgctgctgagtagccttacgttgcaaaatgaaaagagggaagggttgtacgtctcctaccttgggccatggtgtaggacggtgctgagaggtccggttggagaatgaggcgcaaaaggcagagaaaagtctatggtctctgtatgtgcggttcaagggctaaacgagttgtgcgaacgggcgagaggtgcggcgtgaggtggagacaaagactgcaagaaagagaacgaagggattgatggagacgaagagaagggggaaacaagaagaaggatgattgagtgagaaggaaccagaaagaaaaagatgaggaatgcaaaagagtgcaaggcgcgcctttttattggcacggaaaagaggcgtccgcagccgacgtgtgtcattcgctctgttctgcccgcgaaggtttgcgatcttcagacaacaaaaatatattttcattcctgacctggctcaatgagcagaaactttaaaattgccaacagcaactctggtcctttggggagggggccggggagggaggagccattatcagggtcatatgaagcgttgggaccatagccgtaccctgctcgtttgtcgttctcggctttctctctgttcctctcataccctctactttgttcttcagcctccatcttcctcctctcattcctgccattctcgtgctctcggccaccctctcgctcgctcgctctcttccccctcgggtcaatcttcgcgacaggcacttacgccagagtggaaaaagggagcagagtaggtgagcagcgatgagaaatactgcaagagcgtcaattgagagctggacggttgcgctttgctcctgttgtgtatgcgtggcaactttaatggaatttagtaatcgatggctgcaaaccaagactaggggtgatttttggtctcttggttgaccttgtgttaccagtgacaaaaaagatattattaaatctgcgcgcgtcatcaccgccgtcattcggcaggccgcaaacagtgacagtgcaccggtgacaactgtcaaaagaggtcccatgcataaccacacgtacaatgacccttcttttaccttaaggttaaaggagggtcaactgtcttggctctaaagggtttccacaggcgcccctgtcttcttgtacatactgtccatgtgcagaaatgaggcaagacatgttatcggcaatgattctcaatgagtgatgcttttcacgctgtgcttttttttattgcgagggtgtaatgagtaaaggagagaggggcgtatttacagaacgtcaacgtttccgagatccttgcaggcctgctggacacgggcgaccatggtcttctcggcctcacggacccagacacgaggatcgtagaacttcttgttgggcttgttggggccctcagggtttccgacctgggcttggaggtaaccctatcaacagttgtgtgagagcgaggcgcataaagaaaaaaagatatatgtgagtaacaattcgaaatgagagggatagcaaaggtgagattgtccaatcgatcaaggttttaccttcttgttctcgtagaaatctctgatgcccttccagtaggcccactgcgtatctgtggagggaacatggcaatgcccaagtggagaggagagcgattagataaagaacgcataacacaattaaagatcccctggaagactgtcatatttcttatcgccccattgcaccgcaaaatccagcaaagccagatttggataccacagacagataacagaactttaacattcccagacgcgaaacccagaaacataccagtgtcgacgttcatcttgacaacaccaaagttgactgcggtcttgatgtcctgctcagtcgatccggaacctccgtggaagacaaaccagatgggcttgtcggtgtcgagcttcaactgctccttgacataagcctggtgcttgcctagaagctcggggtggagcttgacgtttccgggcgcgtagacgccgtggacgttaccaaaggcagcagcgatcgagaaaaagtcggtgatcttggtgaaggcgttgtagatgtcaagaatgtcctggggctgggtgtaaagcgaagcgttgtcaacctcagagttgtcaacaccatcctcctcacctccggtgataccgatctccatctcgagatggcagtcgatcttagccatacgggtgaggtacttgacgcagatctcaatgttctcctccttgctgtcctccgagagatcgagcatgtgggacgagaagaggggctcgccgtgcttggcaaagtactcctcatcggcagccaacatgccgtcgaaccaaggcagaagcttcttggcgcagtggtcagagtgcagaatgacggggatgccataggccttggcaacagcgcggacgtggtgggcaccagcaatggctccgagaatggaggcctgctcgtccttgttcgagatgcccttgccggcatagaaggcggcaccaccgttcgagaactggatgatgatgggcgacttggcgtcacgagcagcctctagaaacgaccatgcacacgcggagaattgtcaaaactcgtgttaaaagattagttgcccttgaaacccatagcagtgaagttgcagctgtgcagcggagagcaggtgaacaaaagaacgacagtttaccgagagcagcgttgatggtggaggacgacgtgcagttgatggcggggatggcgaatccgtgcttggaggcgtagttgaagaccttgcggacgttgtcaccggtgatgacgccggcgggaacgatatcgaggagacccatggtgaatatgcgtggtgtgttggaaggaggttggagtgtgtgagcgagtgaaagagagaaccgaatgagacgaggcaagagatggcagcggccaagacgtattcgtgagaaatccgagaccgtggcttagcctgtcgtgccctccttctgatcttcaacgcggtatctctcgagaggatggacactgtcgttttctggcgatccgctgcaacatacgccctctgaagccaggtgttccacgtcgggacaaccgacagctcatgtagcccagctaagacacatccgaggcatacagttcgtctctcgcatagatccatgctatataccaaccatagatccgtgcaatataccaaccatcttcggcgataatcgtctgaatgcttttcgtaacagaagctacatatattcttcatgatcatatccgtgcaactcccacagcgcagttgccctcgctgcgttccatcgctagtcccccgcgcgaagcactagttcgagctaaaaacacgtgatatatacgaaggataaacagccaagccacattactttccttggactcgcttaatcccccctacacacattcattgcatccggacatcaacgcaggactctggaatccacctaggcgcagtacagacacacccaccatgttgcgctcaatcacaaggacacctctcggcatggccgcctcagcacagaagctggccgtccgcacactgatgacctcactccccgcctccgacagacctcgttcgtcggccatgggcgctattcgtagctcgggcaactcgaaggatatgttggacatcaccaacctcgaagaattccagtttgacgattccgccacggtaatgcaaaaaaaaagactccaaattgccgagggcacacaaactccgtgataaatcgtctagacacgaattcaagagagagggagagggagaggcgcaaggaacgcaaaagcagctacgatctactgacaccgttatcaactcgcttattgctctcctccgtggactgccggatagatcggacacgactacctggagactcagcgtgaggtcaggaagtacctccgcatcaccaaatacgagcttcccaaactcaagggtaattcaactttttttttttgttgtatttgaacattttttggacaagcacttcaggaacacaaactggcaacccgctttgcagttgtcaatgatttttgcgctctcgtctgacccaggatcttgaatgatgatacatgtatatgtatgtcgatagcctatgtgaagccatttcagcctcccaccaaaacccagatcctacgcttcaggacctcgacatacattggtgaggccaatcacccagcagcgcgcaaggtcgtcctcacagtcgacacgaaatcattacccttgacgaacccagaactgcacaaattcctgctcttggtgggtccccgctacgatcccgtcaaggaacagatcaagatgagctgtgaaaaattccaggatcgatcccaaaatttcaaatggttgagcgacactctcgataagctgatcaacgaggccaagaaggaacccgagactgtcagtgatatgcccttggatctgagacacgctgccaagaacatgaagcccaaggtcaggttccctaaggagtggaaccgccctacgaccaccaccactactaccaccactagcacgactgcgactacccctgctcccgagaccgcatagagaggaggattaattcgttactttttattttaccgtctgtatgtgtgttttttttcttttgttcattgcctgtttcatctccccgtgcccctttgcgttgattacccatctctcccacttccttccaagttgattcactatcatagctcgaatgcagcttacaccaatacaatcacatagatatcgccgaaagaaaaaaaaagaatatatttcaaaagtatgatacagtggacagtgggacaaccgtggtgacgggaaaaaaggtcgttagcccctcagatagtcgaggttgtacgtgggcgtctttatcctagaatccgcgcctcgaagatgactaaagtccatctcggccttgacgatgtggtgtccagggatcatgaccagtcctacgaagcgctgctctataaatacataaatcccacacagtgcatcagaataacaaaaaagaagtgagaattgttagcctttaggtaagggcccagaataatcctttctcgcctgcagagtgaatatcaaaaaagaaaggacgtgacttgcctgcttcctcctttttgttccgcaagattgatttcaaactggctgatcctggatcctcgccggttgtggttatcgacggtcttgtcgaggaggtgagctggctgcgatgggcagcctttggccgggactcgtacgcgcccgagaggatgatgttcttggaatgatcgatacacataaactgccctacaaacagtctcccgtccgtgatttcaatccttgtgcttcggttcaacaaagatcgaagcttggccaccaatggcggatcctctcttggttccatgatgtgctcaaagttggaacggatgcaaacagtgttgattgcggctcgagattgaaaaaaaagggcttgtgaccgtttcgccatcgccaacaatttctcacccttttcgtctcaggtctcgggtcaaaggacagagttcttacgcagctcgacaaagaacactagtcgagcataagtttgtattggagtttaagcagactacgataaaagtacaggtggttgtttttttaacagggaaaaagtcaaagtggcagggaaatgtacaacaaatagcgaagaaaaagaaggacggacgagcacactcgctcaacacatggcgcggctggagccgtagcccctaccctgctggctgtggtccgttgggtcaggtcgggcaggataaccctgattagtggcataatagtgacttgtcgctggcggcaaatgcgacaaccgcgggtccggtgcagacccaggcatccctccggtctccatccatcgactgtgtgaggcggcgtatgcgctggcaacatgagcatctgcaggtacagcaatgccgtcggggccagcatcgggtgaggggtactgatcctcattactacgaataggtcctttgtacaaaggcatcacctcaccctcctctaaacaaggctggttgggcagagaggggcgtcgcttgaagtgctcttgaggctgctgtacataaggcacctcttcagccatagtgtgccggctgctggaacccctcttgttactgctgaggtggttcatcggtgcagcctgggggagataactgcttgttggggagggaacggacgcagccttggatgcagacgacgcatatcgggtggcattctcgggggaggcagtgggagtggcgaccgaggatgagctggtgcccgcagtagtggcagactgcagctgcataaagtcttgtaagctggaggccaaatctgactcggtgatgcgaaggtcaaagtccaggagtgagagcagctgcttctccatcagattgacctcaccaaccgaaaagacggatgagtgtgcagaccagtgcttatttttgggcgactggtcattcaagtacttggcggccacgatcaacgtggctaaaaacacgcgatggcatgtacaatgcatacctaaagatcatcagagcaaatggaggcagccgtcagtccattgaatatgatgatatgataatgttggtactacagggaatacaacaatgatcgcattcgcgaaggttttaaaacagcacagataaactaaaaactacgccatgctttcgcacaacagcaattgtaccagccaagatgtattgcttcgggctctcatcgatcgagcagatcggggcaagcccaccgttctgtacacagaaagtgatatcgaagctgtagaacaacgaactgcgaaagaacaacttttccttatatcgaagaaaagcaccaccgcctcgtcttgaggtcaaaagacttttaaaagtcgttgttgattcagaccgtcatggtcaatgccaggaggctgaggagcgaaagaggaagaacgaacaaggacagataggagaacaagggggaggtagagagtggattgtgtgtgactttgaccgagctgcacagatctccattgcactattttttttggaacgccgctcaatcccacattctcccacaagatgtcatggtgagcgaacacacaaacacatacccttggcagcgacaggaagcttgtatttgagacgctcaaggtacacaagagtgggcaacagtgttgatgactgcacgttcgagttgaggaccagcagccggataaagtcgtttagtggcgggaccacgacgacggagggctcgtgatggctgctgttgtgcatacgcgagcgatttgcaggcgtgttggggggggagggcagggtgtaagggtccatgactggtggcgggctgcactcgataacggtgctggcataattggcaatgtgatctgcggtcgcggaatcgggagataaacagacgattagagattagaggctggagtgaccaggaaaccggaccaacgatcgtgaagcgcagcctaggctagaccgcgtgtggtctcccagcaatttcgattgttctgagaggtgtgtcgcaataggggcagattgggcgagaggaaaacgaagtaacaaaggaagcgggaggacggtcgtgcaggagagggaggtgggtagcatggggagtgtaaaagtcgtccttgggtcaagtactcaccaatcatctgctgggtcaccgggctgcggaacagcttctctaagctccggttagagtatggcttgggttcggaaagagatggcatcgcgcgcaataggatttcaccagggagggagcagaggcagcagagcggggatggagacggggagctggcaaaaggaaagagcaaagagggactgagagccggcggcagcgaaacggactcttttcaacaggttggaaggaattaaaattctatatgggactgtgggccaacacacagttgaaaggcaggaaagtgggagcaagaaaaaggcagaaagcggcagaaagcggcagttgcaacgaccagaggaccaagagaaaaaaaaacgaccaaaacgaataatgatatgaaccggactgtgtggaattgtctggcgaaaaagctggagccaaatctctcttcagaccaaggctgctaagggatcgattctggttctgtcaaaagggaagccggaaggtctgatcactggcgtggcgagggttggtggcggggggtggggggtgggggtggggggtggacagggtagggcgagcaagggccttgggtcgttctacaacttggtggcgggtttcgaaagcaaaggaatgacgaatgagctgatgaatgacaagagaatgctaatgcaaaacgaagaaaaaaaacgaagggacaaaagagaaaagtggtggccagggaaagcgagcacaggcggaagaggcgagggtgtagggctgggatggatgctgagcgagggagcgaggagcaaggtggacgagatcaaaggcagagacagaggcagacgacaggccacagaagccaacagagcgaacaaaggcgggcaaagaaagggcaaagaaagagcaaaggagggaaaagacaacgacggtgatggtgaagagtcgagcaggccgcaagagggaaagcggtgcgtatttataagaagtctttcgaagcacaaatgaaatgcaaaactaaaaagaaatgtgttggcctgtgggctgccaccgacttatgcaacagaatagagtaatgcgcgactctatttccttggtgtgtcttattctgcatatccattcagtggcctattcagtcgagagacagtcctgcagcgtacttgcgcgagggggatgggaaacatccaccgagcctagctcggtctttcctctactgccccctccaccctgtcctccctcacgcagacagatacgcagacacccatgccggagaattgtcctggggtataaggtataagcatgcggctgcccccatgcatcctcattgacaatgccgccgtatcagtgctacggctttctgtcaaaacaaaaaaaaaatcttcaactttgaattcagttgaaaaaagaatgctgtataaaaaagttctcattcattcccctttattcagtgggccgttcttcataatggcctgctcctgccccctcgctcctaccgttggttacccccgttttggtggaatcactgacctattgttgactgagtatcggcctatccgtatagctgatggcacgctctcagcagcaacaccagaatacagaagaccgagaagaggaccacatgttgagaaagcacaggatcgcagaaaaaaaggtaaaaagaggtgtcaaatagcatccgctgtggcgatgctaggtccgggccgcctccagagacgatgagacaccagagggtcgttttaattcctcagcgtatgcacattgcagcctcttagaaggaagcaatagcatctttaaggaatggaaaaaatccgtgccaatgccgttgatcaatgagatttggaaccagcatcatggaccgtggaaaacgtctgcttgtggaggcatgaatgggttgtttaagaatgaatgcagatgcttttctcaagaaaatcgccgttttccctcgttcaaggtgggatttctcactgacgagtccttgatttctataggacgatccggcggtcatcaaaggaccgccatttctcagtctgctgcgtacgtagaaaagagacccgatcgactaataggatggcacacgatcgtgctcgctatgcttcatttcatccagaaaaagaattaggcaattggaaccgagagcgttgccgaaacgaaaacggtgccgaacacccaacttcaagatcttaataatgtgcttgagaatgagagaccggtagcttgagaatgagagaccggtagcgtgtgaaagagagctcaattttggcagatcagtggaacatagagtatgtctgcggtattcgaaattcgcgccattggtgatgatcttgaagcgccatatccgccttcttcatcagcgcattttgccgccaagaatcgttgcgcctcgcgagcgttttaaccggatcgtccaagtgtttagagatatctaggatgaacaaaaacagcggaaaagacttcacccagcactctgttctatcgtatgtcccggtcgagatgcccacgcgcaaaacagcagagacaccgtctcgtgctcgatctcaggttgaacaggttgaaaagtgcatcttctatagaccaggtggtctcgtctttcatggaccgcttcctgcaacgaatcatcttctgcttgtctttatctttgtctttgagagcaggacagagagctacatccctttctcgggctcgcgtgtaaagctgataaagtggtgatcaagatgaatggagaccagttgccggcatggcgactcttcagactgcagattcgaccctaataaacaaaccccgcaaacgtttaaagggtgctcggacatttgcctgttgcggtcgtttctttgtaagctctcagctgcaaactacatctctttttgcttacatgtaataaacagcagcagtgctcacatttggcggtttttgctccacacgaatggttcttgatgtgcaagcatcttgccccgttataatttctttcgtgtgctacttcctctcttcgtgcctaaaaaaggggatgaggaggggcgtcgcgttggagaagtcattgcgagggtgctctaaatcacagcaatttattgttcgccacaagtagacgagcaccaagagcatttctccgtgaaaaaaggcatgcacatagggaattcctaggtagggcaagtcttccagctcagtagcccttcaatgtcatcctctatcgagccgctcagctcctcctgctgaaggcacgggagggctgtggcagaaaagcatgcgaaatgagcacgggaatgactacacatcttgacttctcagcctggcgtggtcttgatctgcgacagtagtcatatccgtatgatccggttggccactccaagacaatgcaagaggccagcctgtatggatctatcatggtgatgtccagaagcagccgctgatggccaatcgcataatcgtatctgccctgagtccactggtgtgttatttccgggccttcttgcgctatagtccatctcttttgccgtcatcccaaggaagcgagagcaccactgagcttccgaaagctcattgttttcctgttcatgtttgcaaacaaatggccctggcttctcgcttgcatgcgatcaagctagcttgaatagatgctattggtcaggggagatgcgcacaaataaagtttgaacgggatgcaaggacagagtctgtgcacggtccttaccttctagttgcacaagagcggaaagaacgctgtcagtgttaggtctatggcttgctggcatgtatgcttcgtgcagaagtacaccactacagcactagggagggtgaagaagggggaggatgaggagaacgggagcttttggccgattgataaatccgctggtgcagtgtgcctgaaaatcgaggagagatccatgcagtcgctctttcttcatatgatgcatagcgagcagaagggagtcgtcttagggagcgtgagcaaagaaggggtagaacagggaatgccgattaggggtattacttcgctgcatggggggatccaccctatcttaaagcggcgtgtgttcggccagagaaagaagggggcgggggagtctaatacaaaccacactcgtagcctacgctcactcccaggaacgaactgttcagcgagccaagctacagcaggcgcctgtttttgactcacttttgtgtccttgcaggggccttctttctactgtactctcactttgcatcctggctggtgttcttgcaggccaagggattttctttgttcatgcacgcagtgaggttgccgattgggcttaaaatcaaccaatgatgtcgcagtctattatccgttatcttccatacccatcccctcacctggtgttatgtaatcgagaaagaattatccttcactggtgaacctggggcgaccccgatcaagtagattcagtcgagcggttcgttttacgtgatgaatcaggaaggtgaagggcggatcatgagcggcatgttgccaaaactgctaacgacttagggacgatcttgtaaaaagtcaaacccgacgtgaataattgcttaaaggctttgctatggttatgagcactacaataaaggtcgaaagaaagaaagtaagttgtggcacttagtgccttcattattcgagccggcgcttgtactcgcatattggagccactgctccatttgaagcggagtggaattatccaagtcttcctttgtacttttcagcctgtgtgttttcttttcggctctggcgcacgaacaaacgcaaggccacgtacatatgtagctcatgaatgtaaacaagcgcttacagcatcagggctttgagcgcggaagagcggagcagtttgccgtgcgcgacttttgcattttactgtgcatccaagaagcgattggtgcagacaatagaatggttgcaatagccttttttagcactgtcagtagcgacaacaaaattccgccaaagacattgccatgttcccaggcacgaacatgttcaattggccactttagctttatcttcgtgcatacgtatgtctaccgctttacacgacgccttgaatggacgtttcagaggccaattcagttgcacatgtgcatgtagtggtgtaagtatacctgtcgaaccaattcactgctgcaatctggcaatttgacctgagactagcgtccgtgggccaatgcgaactttgagtatacaggaggaggtcccttacactcaagaccaagtccattctctagaagggtgtccagtgaactcaaaggcgtgacctgaactttttttcgctctggaaaattgttggaagtgccgtgctcgcattgctgaccaacgtggtgctgttcatgcagatcccaagggccaataaaatgtacctgcccggctgtgccaaaagaccaaagggccattctttttggagcggctctaaaagggcaaaaacactacggaccgagggactttctggctatattcggatttgatcaatccaacaaccgaccagagacttgctacgtggtgtctcatttgccggccctcaagattcagaagggtaaagttcggcctcttgtcccctctgtctgtttgccctttggacgtagaaaaagcgtcgagagttcatattcgatagtcgaatgacgagcggcccatttcagagacagtgctgcaaaagacgctatcacagagccagcttctgggtaaaaagtttcaaacttggaggtcgcatcgccctgcggtttcgttgtcatttcctgcctttcaatttgatgtgccgacttttgcactcccgagcgctgacaagaaccacagacccgcagatatcttttttattgagcagagcgttcagttgcaagacactcgtggtcttgatcgagaagtaggtcgctggaagggcaaaataactccagacgtctgcactttcttccactcaaaacatctctcatttctcactcgtatttgactatttgactcttgggcactgccaagtgccatgaagcttgcaaaactggaacactcgagacctctctgcatcaccaatcacttgcactgggtaacgcagagtgggcagtggtaactgtggtatcaggaagaacgccaaggtctttactgggctgaaccacctagcaacggataattcttgattcagcaagaaacgggtagggcctcgaccactctgtcttgccacgccagagatcataaggaccatgccgctctcaagccttggatcccatgcctctcgtccagctagtgcggcttttcgttgtgttccctgtcctcagaagtgtgaaagagctctaccaagttacccttcatacataccaacccgtgccacaccacccaagttctgccaggttcttacaacatctgcctggtacgagatctttttctactgtctggcctttgtgattttttctactggctgttcttgttggtctcgcacgcatgttcctgtcataaaatcactgatctctcgtccaccccaatccgcacgtccaagacctgttgccggtgcgaacatgtctgcgaagcacaaggccgcagtctaaagtgcccttggctgcaggtacgagcgggacaaagaccataacgccgccaccaacatggcacgagctgtactcatgctcattcgggagaaacgctggcccgatgttctgtgcctggactatgatctcgacactcgcacgttcttttcaaaacaataagcgctgtcttgaggtcgctgcatagctgggcaccggtagtgtccagcaagattggtttttacatttgagtaggaccaacagttttcagagtggaagtctatgtgacatgcatgtcatagcccccctttcttttttttttttttttttttttttttttgagtttccgctatgacgagactttcagttcttttttccacttcgttctcattcgtttctgaatccattccacctccctcccctacacgcgaaaccaaatcacaaaacatcgcgctgaatgaacgccattcaagtacacggcaccagtactcaagcacgagaaaacgcacgagacagcaccagcacccgcgccagcaccagcactactggcagcagtaacgacagcagcagccacaacaacaactctctcgcgaccatgtccgactctgatactgagctgcctctgcagcgatcagtctcggccccagaacaggatgagcacacctacgaggatgcgcactcctccagcccagccatcctctcggagcctgcaagtccttcgatgggtcccagtttggtccccaacatcctgacgcagctctcgttcagtctggactcttttatctctcaaaacctcgaggaggacttcacggagcttccggtactcgccaaccaaatgtacatcaactttcgttcggacctgacaaagacgaagcatcaacttcgccatcatgtgggaacgaccaaacgacagatccggcaccaagttgacaacacagccaacaatctaaaatcgcaaatagacacctcgctgttggtctggaagaagaacatgaagaaggcgagcgtggtccggttcatggacaaggtcgcgttcaccctgggaatgtttgagtgctgctgcactccctggatggtttcgcagtacccggagtggatcccttttgtgcacacgattcaggccatgatcctcattgtcgtcaggggctttctctacaagaaaaaagcctggcactactttctacttgacatgtgctatttcgtacgtcttgtgcctgttcctttcagcgactgataagagagcaccacttcgaatgcggtcatgcaattataagcaaggtatgggtcactaaaatcatatgaacgcactctttttttttttttgtcatttaggtcaatgttgccgtgatcgtgtacctctatgttttcccgcaatcacaggcgcttttcggggctgtatggctactctcgtatggacccctggcctttgccattgtcacctggcgcaacagccttgttctgcacaggtatgtgtcccgctgtgaacatgaatacacaagataccgacggttcatgcagttgctgtctgtgcactcgttttgcgtcttgctaacacaaatgagcggtcatcgccctctttttttttgtttgtcgctcatagtttggacaaggtcaccagtgtttacatccacatgagtccccccattgctctctatgttgtgcgatggttataccccgacccacaccatacgcgatacccagcattgaagaacatggaggtgttgcccacggtccattcgctcgaggccgcaatcgcactctacctgacttggcagattgcatactacatttttgtggttgtgaagcagaaggaaaagatcaaggcaggaaagcgagtgacctcttatacatggctactcaacgatcccaaaggaggcatgatttccaaagcagcgcacacgtttggcgaacagtacagcattgtgaccttcatgggcatgcaactgatctacacggtagggcactgttctcgtaacttttgacctctgacacgtgtactagtgcaaggatcgactctatgagatgtctggcgactaactggatcgttgttcgtcttcactagtttgttacgtgcctctttgcgcttttgatataccgcagcttcaggctgaacactgtgttcctggtgagcctgttccttgtcagcgtgtggaatggtgcgtcgtactacatggaggtgtttagcaagcagtatgagaagcagcttaacaagctggcagcagaggtttcttctgccgtggccgcgaatcagttggcgcaggactcggcgcatgaggagcatcagaaagagcaccacgaggagactgttcagagccaaaagagtacagaggacaagaagaacgactgaggcgcgtctggtgcctgaggcaaataaaaaaaaaagcgacgtcatttgggctgctgctgccaatttttttttatggctgctccatcagttgtgttctcatcactttcctcttctctacctgacgcccatcataccccgccaaaatcatcatggaccaattcaaagcactctcccagcagttcaaccctcttgctgccaagctcggcaagcagcttggccaggtcaagcaggtaatgaccgcaacattcatcccctctaccgttcagtgaacgacggaccctcaaccgcgacatgggtcacagacggtgtatgaaggacgcgtcgctggccatcttcttggtccctcttccactgcggacgagagatggcgcctgagctagagctatggatatcaggacaggtcgattatggcaggatgacccacggaagcggactctcgaacctgttcaaggacagcaacatccaagagacttcatgtcacgtctggaatatgcccagaatagcgacaaagggcccgccacacaccaccagcaacccctgctctaggtgtagtagagtccagtggctaaccttccgtatgggaattccactgttgctttgttgacattagtttgcgcaagaaaagatgggaactgcagaggacattactgaactccctcaggagtacaaggatttggaaaaggtacattgagttgcgcctcaagctcgaatgtcacgcacctttcatacggtatcaaaagtactcatcaatcaatgtattttctttactccatggtaaaaaaaaaaaagcgagtggacgccttgcgcaacatgcacaccagtctcctccgtgtcacacgcacataccagaaccctacctacgactacccagctcagcttcaggagacccttggcgaatttggacgcacagtgacggacaggatccaacaagtggcgctttcgcccgcagagaaggccgcctccgaggcagcggcgttggaggagcgcaaggaggcggcgcctcccaagactctggcccatgcgctgtcccgtgccagcttccagggatcggagcagctgggactggaggagcccatgggatcagctttgttcaagtttgcgactgttcaggagaagattggcgatttccgcctcaagatggaccatgagatttcgacaaagtttgtccagccctttggaacgaccttgaacactcagattggattcgctatgaaggccagacgtaatgtccagaatgcacgcctgtctctggattctgccaaggcccagtacaagacagcgagacccgagaggtcagaggcgagcagggtcgaggttgagcaggccgaggatctctttgtggctgctgttgaggaggccacgacgctgatgaagacggtgctcgagaatcccgaacctctccggaatttggccgacttggtcgctgctcagcttgcgttctacaaggaggcacaggagatcttggcggacgttgcaccggagattgacgagctctcggtcactcaggaggctctgtaccgcaacagccgcagcgaatagaggaggagttgttgtcaatagcacgcacgcttttgttttcttctttgaggagacatcactgaggatgagtgacagggacaggttcaaaagaaggatttagcggtccacggaaatatgggaatgggttcgtcatgagcaaaaggacaggagggttgcagccagatcattaaaagatttcacataccaacgatcttttttttcttttatcgtcgccgaccagagccttggcatttaaagcgtctgtttacatatccttgagaatgtcttcctttctcgggcggttgttggggccagtagtgcccctgccttcctgctgaatgtccagccctccaaggacaacaccgtgcccttcctcttgttcgacccaatcggccagttgaacgatatgatccagcaaaatgagtccatcgtcatcgacgtccagtcttcggacgatctgcttgatgttctcttctgcgggcgcgtgccggatgaccttcaaagccgcctccaggtcagcgatcgtgacctctcctcgctcgttggtctgaaatgcttggagcgtgttcccgaccgcagcgtcaaaggcctccagttcatggtcgagtctagaaatgatcttttcgagtcggtcgcccaatcgacgggcggtcttgagttcctgacgatgcgtggcatgcaccaactcctcaatgtcctagaaatcgggttgacgccataaatgtatgccattcagtaaaaggtaggtccccatatcagcgaacccaatgtatatgaaacaaacggacaaggaacgaaaaaaaaagcgcgccacatttaccgctttgtactccatgcgatcctctttgagatcttttaatttctcgcgttcttccaagactgcagaccgagaggacatgatgcacaacgcctcacggagctccagcaattgcagtttggtgagacgagcctgttcatctgtggcctcgtcgtcgtcgttgtgatgtgcgctcacgacctgcttggtgttgtcctgagcaatcatcgcgtggtctggagtatgtgtagccatgagcggtggaggtagtgaaggacgtggtgcggacggcgctggtagtgttacagcgggctctgaaggagaggggtctttgaccgtcgtggcaagagtcaggtcgttgccgggttcgagaagagcgatgaatgaaacgtgttgcttatgctggtgaatccaccattggtacttgtcctcttgcgccttctcttcagcgatgagtgcttcttgctgctccaagacctgtagtttctgtttggctgtggcggcgccctcgatttcagacacgtccagttctgcctcggtcaggagattgtccggtaaggaggacagggtggcctgtaaggagacctcgggtggaaagacactggcggcgccgctggggttgtctgagaaggagaaggcacgggacaggatcaagagcgaggaggggatggcgtaggtgagatggagttcgagccattgggccagttcgctttggagacgtgcgtcggacatcttgctggtgcatatgccacgagactgacatgctgcttgcagttcacgggctgtcaaggactgtacaccctctgacatgatgagctagtaaatagagtgatgatgggggcataggtttcataaagatcaaaagcacattggcagtgtagggtgatccataacaaacaatcatatccatcgatcgatccttttttttttaccttgtcgtctcgtttgatcgaattcatcttgatacggataagatgccgcaaaaagttatctgtgccgaaagcattcaggttcatgtagcgactcatggacaccagctgtggtcgcgacaggttttccagggtcaactcatcgcgaaagagtttagcgaccctgatcagctcctcggtcgaggcctgttcgcccgagctacgaacctttcgaaagatgtccccaaactccttggcggcgatcgcctgctctgagcccggtatgcctgattcctcgatggtctcctgtaagaactttgccatctcgagccgcatcttgagcagctttcgcctcttttcctcttctgcaaacttgtcctcgaaagtggagggaagcatgttgggaaacagcttgagggccacggggagcaagaactccatgaacgggacaatgacaaagactgagaaggggatcaatcgcaaaagatcgcttgtcgttcttcgcagctaccagcaggtgatggatgataacaaaaaatgcaatatccatgagtacactggttcccacctcgactttgaaaccattcaaaatcttttttcgagcgtaggttttgcattctacctgcttctgctcacgccttgttagcttttggccatggagtaacctattggcaagctttgtcgagatcctgatctccttgcccagtagcttggttccatcccagtaatggatcagctccttcttcactctcagccagagcgacatcttgggctgaaccgcagctgccgcgccttgcccagccgaacctgagacagaagcagcagcccttttggcagcatctgcggcgtctttggttgcttgagctgctctgactttggccatctcggcggatctggaggcgagcgtctccttctcgagagcaatagcagagcgaagaagcagttgcggcttgtgggtctgcgcctcgaacgttcgcaagagccctaccgctaaggcggttcttcgaggagccaagaatggagacggggatgcggacgagtagaatagtgcatgcgtggaagcggtgttctggtgctgatggcggctgggacgagggcaggttgaggagcggtttgagcacaccaggatataatagggtgctgtgcccaagagtggggcacagcagggtgttttcctcatgatcctgttgacagacgttcctccgaaggggcccaccttgtgccttttgcgcgatatcaacggcgtgtcagatcagatcagtgcgaggaaaagtgagggcgaaaaaaaaaaagtgaaagccgcgatctattttcgaacaaggtggaaatggtagtgtgtgggttgagacagtcgttttgggttgaggttggaatgagaaaaggtgaacgtacaggcttgatcgaaatccaataagaccctggccattacactctcggttacgaggccacatacatgtcgtagtctatcgacatcaacggtttatgtgggtgcacattcactgcagacaaccagtggaggacgcgtcgtcgcaaggtctagtgctgtctctgttatttcgtgctgtacaaacatatgttgctgccagccagtggagtgagtacacgcctactgctgcctgtcgctgttcagtgttcgcgacccggatggatagatggacttgttggccctggtagtcgccagtcataccagggtccccacccgtaggtgggacggtctatttcggggaaactccataaacaaactttgactcttgcatttttttttttttgcctgaacttcacagcaccctacctgagtcttcgtcctttgtccttcgtctcagcatcttcgttccctatccttgagccctgcgttgtgtgtgcatagtccgtaccactgccgatccgccttctctgcagagtgccatttgccactgagatagatcagcctgcgtgtgtcaaggactggctgcagtcgtcgaagttgttcatcctatttttttctgcatcagcataaaattttttttactttatcactctgtgtctgccttctctgccgtctctgcactttgccctgcacgagaacaacaatacttaaccgttattttcttttcctccaacggtctctcgtcttgtccatcctcctctcgctcctcgtttatcgtatcctcttttatcgtaccctcttttatcttttatcctcattccctcgtctgttccccactcatccgccaccaaaaaccaagacccatcctgctggctgccacaacccgccaccaacaccccccacagtctcattgaactccattggccttgcttttgctttgctttgccttgctctgcctcgctctgccttgtccttcgaccagcccttccgcagcccttctgcagtcgcccttcgtcgctctttcctcctctcctgcttcgcctcggcccctctccactctccagcacacacttgcgcccttgctctcctagctcaaggcgcaatcgaaccccattcaaggagtcttgctgccgcccatcaagacttgacatgccgacagtccagaccaccacccagtctggcacttgtcccaactccttctctgccgaccaccaagtccaccaagactcgcaggaagacccgcaaggccacagcagcaccacccatatccaccaacaccaagacacgcctcttgtgaacggccactcacggccagagtctgcagcaccactccagaatcctctccaaccagagacacaggaggaacgacaggaagcaagtagcttcgaagaacaggtgtctccagtgcaggatcaggcaataccaagccttacttcacgtccacaggatcatagacccgactcccccgccagcctggaggactccttctcagagagcggactcgacccgcagactgtcgaagccgtcgatcctgtagcaagacctatgcagcgattttcaaccacgagcccatcaacaaccgtcgttgatccaaagcaggccatggtcgatcacagtgcgatgacgatcggcactgaagcctccaacgccagcactgcagtgtctccttcgcagattgcaacacccccactgtcacccgcaaagatcctcagtggaaaggtggctcctcccgccgaggacgatcaggaggaaggaaggggtggttccttaaccctgctgccaccacccgctgcaagtttaggtacggccgaggaaaatggaaaggggctcgaaaatcaacccgaggatccattggaggacgtaacagcggagcagtctggaacgcaagcagcattgtcgcaggaagagcaaagtattttgaccacagagacgatgaactcggcaccccagcctgcaacgcatgcttcagcgcccaaagtgtctgcatggtcaacgctgctgcctggtgtagcacccattcccgcaccccggacggtaactcgaccttctgcagtacaaagatcggaagaacaccgacttcatgagcgtttccccattgtgcttcctcacgaaagtgaagccaagttgtcaatggaaatggtcgacctctttgaggtaagcgagccgcagatctctgtctggcaaaggcagcatactcggagactgccaaaatgacacatgagatctgatttacctctacaacctgtaccttaggatttactgcccacagagtccagtcatgagcggagaactctgctcatcaagaagattgaaaacattttgcagacggagtggcctggacaggatatcaaggctcatccatttgggtaagagattttctgtcctttgctgtaggattcgtgcaacgtctagcctgtgaccactccactgactgacttattctcattgtttcgtcacttctcagctccacggtcaatgatttgggaacgggttcaagtgacgttgatatctgcattatgacatcctggtcgggtctgaagaatgttcagatgttggcgaacgcatttcggaaacacggcatgcaaaaagtcttttgtgtgcccagagccaaagtgcccattgtgaagttatgggaccctgaactgtaagtgcacttttggttctttttcttgggagatgcaacttcgcgttgggatcgataagaaagttgttttgggccttgattatgcgactgatttgcatgaaacacgtctatttattgcccggcttagtcacctctcgtgcgacatgaacattaacacaccgctggggctgttgaatactaaaatgatcaagacctatgttgcgattgacccaagagtgcggccgtttgctatgatcatcaaacactgggcgcgaagaagagttcttaacgacgcaggtatgaaacgagaagaactttgggatatgaagaacaacggattcgggtaccgcgaaagtgtagtgagcacttgtactgactgaccttttgcttccctgtttgtatcatgtgcagccaatggtggaaccatttcaacgtatacctggatctgcatcgtcatcaactttttgcaaatgcggtcgccacccatcttgccaaagttgcatcaaatcccgcataccctttcagacgataatcaggtcatcaatggcaacaacacgtccttttgcaccgatctcgacctgctggagggatttggtctgcccaacaaggaaactttgggcgggcttctttacgccttttttagaaggtactttatgtgtctttttattgatacttgtgagacgatttttatcaaagcgtgagcatcccaacggtttctaattccgcgactgaacaatagatttgcaatcgagtttgactatgaccaccatgtcatctctgtgcgtgaaggatgctatctcaccaaggagtctaaaggatggcaccttccagggaagcaatacaagctgttttgtgtggaggaaccgtttgataccagcaggaatctaggcaactcgtccgatatggccagcagcaagggtttgaaggaggaattcaggcgggctttggatgttctctatcaaaaggtgtccctggaccaatgctgcgcccagtttgtctttcccccaagctactaccacagcaacaacaatatgcgcaagggcagcaacggtacgatggtgaccaataactatggtgcaggacggcggtatggcaatggcttccggtcactcaactattactacgatgatgcggattatgatgatgacgacgaggacgatgaagcagcgtctgctggcatctccgtcatggaaacgctcaacattgggacacggccttcgacgagcaaagacccaacaggcagtagcaagagccgagactctcatcgctcggccaatggcgaccatgcggggtctggcaagtcaaataaggaaggtgcaagccaatccggagcgggtcgtaatggtgactcgtccaaccgcagtcagtcacgcaaccggacaaagcaaagcaagagtgacaaggacggtggaggagagtccacacggtcaggatcatcacgatctaagcaggacaagtctggaggttccggctcttcgtcaggtcgccggaacaaaaagtcatcagggggtgatggacagaagaatggtcgaggcggcggtggaggtggcaatggaggtcgtgcgcctcgtgctgctgtagagtttagtttagcggacattgccaatgcggcgcccaagttgttatccgccaccaagctcgttcaggacacgtcctcgcaggcaggtgagggcactgcaggatcagatgcgacaggagaagacggctcagggacgaggaacaggaagaagggcggtagacgtaacgtcgtgtggtcgaccaactctaaccgtggagagtcttctcgacgacagcctgtggcaaagtcaggacagccggcggagcaggaaaaggcaagagtgatcatcgtcgcgcccgatgaggaaaagagcgatcgatactctagcccttctcctgcatcatcatgatttgggaacttgaacgaggagtagctttttttctttttcgcctcgccatcttttaaacatatcctgccaagtttgtgcattactaccatagaagtgctttttttcgcgtttccgtcattatttcattttttttttctttttcatttcctttcaatgcttgtatgtttagaccgttcattatcacgctttcctttctttgtttttcttttaatgaaaactcccaattctacctcgttgagatgatgcgatggttaaaggttctgcagacgatgaacgagtttctcgtgcaggtattcactcaattgaaacagtccatggctgctgacgatccggtgcgagggcatcctttggtaggtggagggttggaggacaccgtccacaatctgtacgctaccaaagatgtcttctgggagtggaattctacgagatacattcccattgtccaaagagtttcagtaagaagataatggtgatgttgatgagataaggccgctgaagaaaagaagattggggtgagcttcctaccttccgtagggtgctgggttgcgatagtctgcaatgtgtgtccatctaaagtcaagcacaaaaaaaaaaaaaaatgtttaggtatcaaacagattcaaacctggcaaggccgttttgttacttctattttttcctctcatttttatttttcgcatacccttcaagttgttgctgcaggacggactcgaccattggatccttactcaggtgttcctggatcgaggcatgtaggacggcgttgaaagcttcgttctctgtgaacttgttgggcttgaccagcagctccgtgttggcagggttatggctgacaaatccaatgatctgacggttgtgcttagggaaggtggggaggaaggcgagcgcgtagcaagagtgggcgtcagaggaggtctttggtgctggcggggactggatgtggctggcagcagcggaggaggagggcaggaggtggtagtacagtgggaaagggtaggtggtgtcacggatcaggcgtcgttctacagaatggaaacgtgcaggagcaaatggtgttgcgggacgcggaaggggtgtggccctcgcctggcagactttgagcagacctgattggcggctgcatagctgggcgaggtgcgatggtcgaagggttggtaacatggctgtcgggttttgtggaatggacgagtgaacggcggaaatgaacacatgaaagtttcgttctagctgcaaaggcctgaagtcaggtgattgaactcgcttggccattttttttcagcgcactgacacgccatggtacaagagagcgtgtcagttctgaatgttggattccttctcttctcttgcctcaaaagaatctcgacccaaccatggaagcccccagtgtcacccaggagacctactctccccgcaagtggtaacgtagtctcgacagacaggtcgctggtgcccgcgagtggagcaagaacaccgtggactgcttgtaactgtgtggagtgtgaaaaagaagagcaggggattgaataggacgcgctaattcgcagggatgccactgagcgtgctttcatgatgacttgaccgggcttgaaagctgcccttagtcgaattggcgaaggggaaggaaagtactgtgagagtgaaaggaggccctgcatgctcatcgttgcttgttcctctctacgcgacgttggaattcgcaaaatagctcggccaccaaccgcttgattgccgccaaggaccacgcttcggtccagattaatatcggcgatgtggacgcttccggcaaatacactggcaccttcaagacatacgctctttgcggatatgtccgcgcccaaagtgaatctgatgattgtatcaatcgtcttgctactcgcgatggctgtaagtgctcctgacccttgtgtcattcacgtctctattcataaaagtaaggcagttctcaactgatgctcgtcctcttttgcttttactcgctttttagtgctgagccaggtctggagctaccaaaagtagagtaagcccttgctctcccagcgtctctgtctggagtcgcatgcctacacaggccttgacgtgcagatgtttgtgaaaaaaaatgagcttcccgagcttataaaaaaccacggcgcctgtctttcaacccgtttgcttttacaattgttgtcatattgtgcgtctgaggcaagtttggaacagatttattgttctaaaaggtatcctccctttgcgatccattgggcaaaagtgagtgtaaaaaaagtactgtacagaggcaaggcttgctcttccgagacgtcttttgtggagcagggagccggcggcaagagaaccgtgatatgaatggtgtcggcaatgagcatctatgctggatgagaacacacgcctacgcgcctattgtgcggaacttgtagtggtgctggagaaatctggtccatactttttagagaaaacgacggaggcgtataggagaggatacaggcaagtaatcgttagtgagacaggatcagtcggaggagagaggagtacatgtcaggccgtagactgtcctcctccaacaaccacacgatttttttaaaggggagaggacaacgaggacataccccagtaggacaccttcttgccgagccaacgtccgacgaaagggaaaatcacgatggcaaagagctggcggccctgctccatgttctcgtcccattcccgctgaatgtcgcgtgtggaggtggaggaggtggttgaaaactctgagaggtccgagtcgtcgtcgatggagtcaatgtcggacagctgctcgtcaatgtcccatatccgctgtaggagagtatctctggtctcgggtgcagcagtgtcgatatagccgtctgcggtcgttgggagtgtcggggtgctcatcgtggtgcgactcttgtgtgtatgcgggtgaagtgagcgacgtgctcgtaaggcacttcacatgaatagtggcagtggcatatgtgacgtcatccactcatccactcgctctgagcgagtggtggggtgcggaaaagagagttcaaaggcaagttgggtttcgttccatcacaatcgcactttgctcctcccctatctcctccccctctctccttttctggcgtgtccctcagagcaccagttatttgcagggatccctactccattctccaacccgatcacacgagaacgagcgagagcgagagcgagagagtgagagtgagagagagcgagaaacgagtcagcaagagcaaccaagtgaaaaaagagtgccaacagaccgccgactacgccatcaagtcatcgagtccttccccccaacccagcaggagcaggaccgaaaatgtcagactttttcggcttcaacgcagtcatgcctggtcgccagggtggccgagtggcattgaatctggaggagcagcaggagctcgaccgccaggttcagaagtatgcactcgagacgggcgaggattttgagatttacgattatggcgagacatacgacaacctggccgatgatctcgaggagaccagagacgaccttaacgatgagacctttggcgccgtgggttctgacgaaggcaagtcaagtattattttcttcaccttgacacgtttgtgcagtgatcatcttttgagagatcacgcacaagagccaaataggaaacgcttttttttccttgtgtcttttcaccgtatgcagagcgaataacactttttcttcaaacctcttcttgccacaaacaccacttttcatggaataggaacggactttgactttgccaggaacacccgtcaaattgcgcctgcgctcaagaaggaggaggagctctatatcaagcagaacgatcatgttggtgagtgtgtgtctacactggacaggaggcttgatgcgatcagcagcggtagtgacagcagcagcagcatcacccaacaattataattttgacttacgatgttaacggtcttctgccctgcatctcgcatggattcttgaatcaggtgcacgccgttcgtcatttgcgtcgctgtgggagaatgatggcaatgctcagcaagataacttcaagaagggccttcccgaggtatgtgagcatgatacacaacggatcgcgcagtacgctgcaacttgacgcgtcattttgtatattttcttactttgcagtgtagctaacggactctcgatcactttcatgatctctagccttctcaagctgcttcctcgatttggggctcctttggaaacactggcgcgggcatgggtatgtttgatgtttggcgttccttatccgtgcctgtacaagcgcaggtttctaggctgcagccgtagacattgaatgttcacgtctaccctttgcttaccgaatctcctgaatggtggcacaaaaatagatatcagcgctggtaacggcgggtttactcatgaccccgtttttggaactggcacattcgctctttcccgccctggctttggaggcaaccagcctagcttggaggaaatcgaggcacagctgttgaggaccgcaggagcccatgcgcaggtgcccatgcaacaggagcgcaagatgatgagcctggaggaagtcgaagctgcccttatgaacatcaacggagggcgccccatctactctgaggccatgattgccgagcagcaagcaaagcaggcccgaattgagcagcgacgtgaagagcgattggccaagcaggccgaaattgtatgtccggagcacacttgggaagaatattgcagggtagatattctacggcttgtgcctaactttctcatccttcctgtttttgatggatctccacataggccaaacacaacggcttgatgacccaaagcgacaaggatttcatcaatcgcatccagatttctcagctggtgacggatgatccttatgctgatgacttttactgccaagtgtacacagcccttcgcaacagacacctgcagcagatgggcatccctggcaacatggcggacaatgaatcgggacagaacgacaacagacgccgcggaggaaatggccgcactgagcagcgtatgcaacagcaggtccaaagaatcgtcagtgatgctaagcgcaaccccaagcgcaccaatgtgactgtggagggagctcttggcaagatcgctgtcaactcggtcttgaacccccgccagcttctgcaagtctcaaaacgcggatctcacagcaacgagagtgctggtggcagctcacccaagcctccctcgcctggtcctgtgagcaccaagtcgcacaccgtcttgggctggatcgagaatgtgtatacttatgttttggccttggagcagaagcgacgacagcaaccaccacccccaaggatgggcgaggaagagattgcaggagaggcgatccgtcgctggaatgaggagtacgccattatcgcccgtaagatgtggaacgaactccgtatcactgtacccatcggcattgtgtaagtctttacttgtttgcggcctaggaggacgttatcgatgctcgagaaggcttgcaccgtcgatttgatcaactgctaattggcgtgcatgtcgtttttgctggacacaaataggcaccctcatcccttcatttcgattttgaactactccaagggcaagaaggtcattccccgtgtcctccgtcacctgcttccagaacagacgttgaccttgttgaccatgctcgtcgccaattttgagtccttgaacgtctgcaaatctgaggtgtacgcggatgcccaggccaatcaagagattgaattgttcatgaacacgattgttcctccactgctgggctttgtgtcggaggcccccttcaggatcgtcgttgggctattggcgctcttcatcgagcgtaacaacatggtgtgggtcgccagaagcaaggtaaggattgcttttacgcgaatgaagaaaacagggaaaaaaaatcgaaacgatgaaaattagtctacgcagttgaagctggtaatatccttaccctcttcgttcgtctccgtccaaaacttagcccggacttgcgtttttgacacttttcttgagccgcgccgagattctgaagcagggacagggcaactatcccatcccagacgaacgcgagatcaatcaatggtagggttgaacgtttggaaatcgttgagatttcggcaaagattttttttcttcctctttttctaacaagagtttgtgtgcgatcatgtatattaggaatgagctttacaaccgactatttagtcaactgcagacgcacttttctgcgctgttcatgcccaaggccacgatggccgaggatgtccacgtgtggcgcttcttggcggcgatggccgttggcgcagccgtggagcagcaacacgtcttggtgacagaagtgcgagagcaggtgctggagaacgtgatagcggcgcagacgacccgcatggctccagagaaggctgttcagcggattgcgaacgtcaacttgttcctgcatgcgttgggactggatgcttctcaggtgtctgttcctggaatgtaacagcaaaaaaagaaaaaagaataaaaaacaaacaaaagatggatatttttttttcttgttgtcggtgttgtgtgcaggatgatctccttttattcgattttgcattcaacgcgagggtaagcggataggcgcgcctcttctttttatttttttttatgagccgtcagtcgcgcccgtgcttgaagttggagcagcagctggcacggaggcgcgggcccagacaatggcttcttcgtacggaccgtcgtcgttttcataggctggcattgagggacccgcgggcacgggtgcggtggtaggtctctggcggtagtgggcccgaggttgcggaggtcggtaagcaccaccgagaccaccatcatcatccgcctcatggccgccttcgccaccacggtctgtgactctcgatagccccgagggtgggtgagattctttcctcggacgaacgtacttcatactttcgtgagactgtgtcggttgaatcaatgacgatgaaggtggaggagggctttgggtcattcgacgacggccctcacgctgctgtatctcataatctcgaaggaacggtgccgcgtagcgtgaggccgggaaaagaagttccgtgcctgggggagcctcacgacggtctcgaggagccatgcggtcgcgctctcggtcacgatcgcgctcttctcgatacgtggacggtatcctgggctgtgcgcctccgtaggatggttgttgggccatcatcatgcgttgttgatcgtagtgactgcgaccggtgaggggcaacaatggtggtgagcggtagcgcggatctgcggatggaggcgcacggtgggagtcaaagcggccgccgtagtcataggctacgggctccatcgatggatgcgcctgagatacatactgagagtactcgttgctgtacgccctcgggaactgttggaggccttgatagaacgagctgcgttgttgagccaggaatgggtgcactcttgacgacgacgaggaggcagcggctgcgttagcggctgcagcggatccataatactgttgctgtcgcaaatgatcttcttgtcgtcgtcgttgctcatacaggtcacggtcctcggggaagcggtagaactgggcgggaggcacaggttggggcagaggcatcgggtaccggtaggcgcgatggtaacgagaggccttgggtcgagcgtaagccgcgtcatagccgccgccatagccgtaatagtctcgatcgtaggcggcgcgactcgcattagcgtatccccagaatcgaaaggagccactgctgtcagagctgagactttccagactgttgcgacgcctgggcaagagtaaaggctttggttgtcttggcattgtgcttgttgagggcccgtcctcagatcgaagccgctgctttggcgggggtctctctggctctagccctggttcaggtgctggctcaggtgctgccgctgctacgtcttgttgccgttcgacgtgctgctgtgatttctgttgctctaattcgtgctccttttggcgccgctgtatttgactgtactgtgcgacgataggatccagttcgtccctgggatccgggtatggcgcggatggtgctggttgctgttgcacttcctcatcctgcttgtggagctgatcctgaagctgctgcacccgctgatgggtcaaggacgcgggctctggttctagcgcgggtgcgaaggcctctgctggaggcgctcggccttgaagctgttgctggtagtaccgtcgctgatgttcctgctcctccatcagcatttgccttacataatgttcatagtcgtgtccataatgcgacagttccgggtcggagcgacttccctcgcgatggtgatagaattgcccgcccgagaccaaactcgactgcccagagtttgtctctgcagactcgttccgctcatggttctgaggctggctggtctgcacgtcctgagtcttgttcttgcccttgctctcctctgctagaattgtggaccggtccttttggtcgttgttggcaagagctgaagaaacactgccttgcgtcacagcaacgttggtggcgacagcggtggcgacggctttggcgacaatatggctgatctcggtgcttggggtctcgcgctttttggtggcgtcctcttggatggcaaactctttgttgacgtgctgggtgaacgctccgccggctcggatgctttcgctgacatgactatcgggtgtttccatgacccgcacaggggttgctgtcaactcgggccgagtcgacctaggaatgactggcgcaggtaatacgtagggctccggcgccatggcagcacgctccagcccacgatcacggtgttcgaacctcacgggctccatttccatgtcgatatggtactcccgatcccgttctcgttcccgctcccagtttttagaatgaggcgagtgtgtctcaaatggcacgctgtgctgctggcggtagggcatgggaacggggatgtccaaggaactaaagcttgcaggcgaccccatctggtggtcgggcttgatgtttgcaacgggcatgtcaatatagagacctgacagtgccattttcctcgtgaccggatctggttggatatccggcaatgtcgcccgctctgtccgggccgcgtcctctttcccgagatactcgatcctctcgttcttcatccgcgactttggttttgtgttgatgccaaggcgtccggcagtagaggggtcgatggtgtccaccaccggcttgactggtttccgtgcaacgcctcggctcccgccaacgcccacgcccacggagcgaacggtgcctctgggactggcccccatgttgggtgcatatccatgtcccatatcgtacgctacatcagcccgtcgtttcgactgcgctccacctccacgatgctctctgtcggtgtaggcactctctgcaacggaggcgtatcctttctccagatcgccctcccggcggcggttaggtcgatctggatctgagcgctttggtacaggactttcgtcgttgtcattatcgtcgtcgtcgtcgccctttcgtgattcctgctcactgccgtcgtcgtcatcatggccgctggtgctttcatcgtcaccactgtcgtcaccacgcctcttctttttctttttctttttcttatccttctcagactccttcgggggcacgtagggtacttctggtctctgccttccaaaagcacgctccagatccagcagtcgtcgactgtccttgtcgacaggaatacctcgtgcccaacggtacaggtacttgcatccgtatccgagctcacgcagcgtgtccagtgggttaaacgaatcgagcaaacccttccaaagaggcgtcgtttgagtgcggtccaaaaccatttctggtggtccctcctccttcttgtccttttttcctttgctcttggacgtctgttttgggtcgcctttggtggaatttttggaaggttgagttctgccggtgccatctccaggtgagggtgaagacgagtcgatagatgccattgaaccaccgttgttcttgttgttggtgtggtcgtccttgtattccttgtgtagatcatcctcgtcaagagtctcctccaggggtgggagatcagggttgcgaatcttgggaatataaggctcataaccaaaggccttgacgtgcatgattgcaaaaaagaccatctcaaagtcgatcagcagagcgttgatacccaccgagatatcgttggtggaccagtaggttgttgccttgatgagtccgaaccagacgaggccctcgatgaccacggattgccagaatgagaaaaagacaacctagaagagaacaagcaagtacgagagatcgcaggcaagcccatggttagcattaaaatataatgatatttcgagaacattaaaaagaatcttgaggcgcgttccctaccaacttgacggccatgaacttgtagaacggcgagtaatccttcaggtcagctcgtatcgtcagatagaacatgatctgcgcagataatatatacaaatgaaacgtacttttcagcatcgggttttttttgtttccctgtcctctcaattcagtcaatgcacatgggttctttaccaaaaagtacgtcgccaaggacacggacgtaaagtttacaagcatgatccagacatgaccaaacttcgggttccaactgctctcacaataatacccataggcctgcaggaccaccgtcaacaacgtgcccaccacattcaggggcacgtactgcaatatcccccatttcatatactgcaagaaatgaggcctcgacggattgtacttcaaacagcacatcgggaacaaccatcgctcagtcttcttatgccgcttcaacgcccgcttctggtcctcgcgtgattcgcccaggtactggagcatcaggatcagaaaggacgcaatcacaaacgcttcgtacaacacccggatcgtctcgtagtacacggcctcccgcacatacacgaacgagaaccaggacgtgatcgcgtatatgggtaccatcaacagcatacgcacaatgtaccgttgctggttcggctattcttcgtcgtaggaagttgaattttcttttttgacgattagcatcgggtcgagaacgagtgtttttttttttaacaattagaacatgcctcccttcggtcaataagggggcggagggaggccaaatgccctgtaaaaacccaccttggtgtagtattgaagatgtcggtagattaacaccagcgagatgatggtcgatataagtgtgaagacacccgcagcaatccagcctatcctgggcaagtcgaggttcaacccattggctgaaaacaagtgtgtgggatcctctgggtgggtctcgagcgggcagccattgggggccaagagggcagtgttgtgatcagacatgcatccaagaacaccacgttaaagaggcaggggtgaagaaagaccgagtacaaagccgctaaagtgctgtaggggtggcaagtgcaggttcaatgaggacagtaccagagttgtgagacgaagagataaaaaataaatgagagtctcgagaaagtccgttatcgaggatgtgtcctggttggtgacaaaggggacagcagtggaacggtggaggatgggttcgtgaggaggaggaaatctggaacctatccgaagtgggctatactacaggaagaaagatgtgtcgttcaggaaggatggggggtgcaaacatgaaaatgttgaacgtccaagtgtcaagagccccgccaaacgcgattatgagagatatacaaagcgcagcgcccttgtgtaaaaaataacgaaggagatggctgctgacggtgacaaaggaaggataaagagtgggaagggaagggaaaaagagacgaaagaggggaaatgtcagccaggacaaaggataacctagtagggagggaacaaggtgcgcaacaggggtcttgtgctcgacgcactccttttgacttcctccccctctcttctttgtcttcttcaccagcatcatcatgcctccacctcgccactgcttacatgtacagttcaattgtactgtagacactggacaatcccccctctcccccttgacaactgtgcaaaactcgatcacggccaccaacacttcgacatcgcatcacggcccttttatttttttttaacgtgtgtttttgttgtttggtgagcaccgataaaggggctgtaaacgggcagatgggcagagtgcacgcatggcagtcggtcatcaggtccactcaggtacaacgcagcaggtttattctgtacagtccgacaggccgcagaccagatggctgcagcctgcaaccccttttttttgtccttcatgtttatcttgccgctcgttgcactggcatggctccccctccctgaaaatggttggatcgctgtatatttcactcgattctatcatactcccccttcctgacgcacaaggcgcgacttggtgtgctcgagccacgccgctaggggcgagaacggagtggcgataccacgtctttacccttgctcttgcatatgtctttctctctttggcgtttgcactcttggtccataaccgttgaacaggacaaggggaacgacaaaggaggacagggggtagatcaagaacctggcttttgatgtctgaatgcaaaatggattgtattgaagaggcttgattcgtatgcgatgaaaggggagaagaaaaatgatatctagttgctggcggaagggtccctgttcaccaggacagatcgaacaagaccgtggccaactctctccatctcactcatcagagcctcaatgttgggaaccacgagcttggagccagcgcctccctttccagccttggcctgtgtgtccttctccttgatctcctgtgaagaatgaaaagtacattgagtaataaagaaaggtggtgagtatcaagtttttacaaataaagacagtgctccgatgcagaatcgatcgtcaaaagacataccagtacgccgtccttgttgacatcggctggcttgctgttaaagccaaggttgaccttccaggctcttgggctcagcgaaatggggttccagagaacaccgatttgcgttcctccataccggtcatggaaaaacagtgcaatgtcgccgtacactctctgcagctctgccaggtactctgcggcagggtcgaatccaatcaggatctcgtcgccaaagacactcttctggaaagcacccagattcttgtacttgtcgcccttggtggcaaagtgctgagcatccggcgccaagttctgcgcatagcgcgtgcacatggctgggtccaggtcaatgactgcatcataatgtactgttggcgtgatgaaaagcgggttcagtgccaatgagctcgtcgttgcggaggacgacgtgatcatggtcatatgctccaagctggtcttggccagcgtacgcaggcgagcgacaatcatgggcgagggcgattgccatgtccaccacttggagagcagatccttgttcgtggcaataaacatgttggcatggtcgctcgagatcgatgtcgtcttggactggggcgaggtcgctgaggaaatggctgtcatgttcttgcgcgtattggcaaagttgtggcgaatctcctcccgttcctttgcagtcatctcgcccgtcagatccaccaccaggggctcgtgcttccagtcccagtttgccagcaagttcaatgtgcgggcaaagccaacaaatccactagcaggcgctgtccatggtgctgggtcgacatagacagctgctgacaagagttccagagtctcgtcattgaagaagggagcgagccagtgggcgctcacccagcgcttggtcagacggatcgtctgcgacagcgaagggtgcttgtgacagagggcgtgcatctggaacgtgtgcatgggcgcctgaacaaagtatctgttgtaattatccaacgctctctggtgctgatccttgagactctggctcgacttgcggtcagagatcacggcctcgcacagggtcatctcgcgttcatgtgagattctgcagcggaacacgtagccaggggcgacgcggacatccatatatccattcaatccaagggactcctcttgcgattcctcgatgactgttgagcgcatacccttgtacttgatcttgtctgcaagacgcaggtagaacgcagtcttcatcctctggatcgccttcaaattgtcgggccacttctgagaggactcgaattggatgatcacgtccaggggctcgacatactgagcactgtctggaaagttggtggcaggaacgttaaagtcgcgggcctggggaatgaaggtggaagagaggcgtgcggcaggcgatgcaaagtacatgtgcgtaacggacaagggcatgtcctcggcagtcttgatagccttggtcagcgactcaaaagcagcaattacatcctggaagccactagcggcagcagccttattatcaaaaagacgctcaggaacgaccttgctgttgtatcgaatgaacttgttgagctgtcctgcccagtaatgcacagactcatggggcaccgaaaggtggtgcttcagcaaataaccgatcatctgtcccacaatgaggtggcgagcgtccgttccctgggcctcccagacagcgctctccagaatgcttccatccttgaatcgacgaagctctgccttgctaccccagaggttgcggaaaaccttggccgcctccaagtcatcagctggtggtcccaagtcgacgagacgtgagctttcctcgtgattcaacaggagaccaacggtgataaccgaatcagatccaaaatcgggtcctgcacttgaagtagcccagttctctaggggttcgtagcgggtggcaaccaaatgaacacggtttgtcaagcctcgcttcaacagaggcgcgatggagtgtgcaaagtggacaaaaggcgacgggtaatccaacgcggcagttttcgtgtaggccttgagttggtcgaggttcctgggagcgtggatcttgacgacgttatcgaagcggagcatgggattgtcgactctcttcaagaacagcgcctcaaacttgtcgtcactggactctgtgaaaaatttcatggccaaacgagcctcgtgctgcagctcatcgagcgctgccttggagacatgtccagcaaggttaatctttcccgaggggtccacgatcacgacctcaaagttggaaacaaaggcttccttcgaaaactctccagaagacgtctgctgacccatgaagatgggttgagcgtcaaagtcgtgctgggcaatgtagtcgatggttcccttggcgagctggtatgaactgaatccgttggcgagtttctttcctccattagcgcctcctccctgaagcaggtaagccatcagcatttccagtaagaatccgttaaagccttcgttcgtgcggcggattagcccacgctgcgtggcccaaaccttcagcaggatgcagccgtccttgaatgcagcacagtttttgctgtgctggtacaggaaggtgaggtgagatgtgaaggcagtgtcctgttgaagagctgtgttgtattgaggagtggggggctgttccgtggcatctgctgagcggacattgttgcgaccaggcgccaaacgctgggcagggaatactgaggcggggatataggggatgatgcgaatagtgcacttcatctttttaaagtcggtctccttcttgtctatttgaataaggtgtgagagagaaaaagatgtcagtcatcaaggttttttaagacggagtaacagctgcttatggtgaagcaacataccgccggaagggtgcaagatcagaataggcttgcgctgatctccattcaaggtgctgaactcggtacgagtgttggacatgcccgactttttgtcctgaatggccgcggcgagaaccgacaggtagtacgcgcgtttgtaaaagtaacggtagttcatgtggtccttctcctggaatagctcctctggcatctccactgcaacgtccacgctccagccatggcggttcttggcaacggtcttcaaggggaaactgccgacaagatgcatggctgagggtgcgctgtagccgaatgtgtactggatatccgaggctggttcaggcgaggggaagggaatgacgatcgactttttcttcatgttgcttttgatggcagcgagctagagccacaaacggttagtcaaagcattgttagtccttcgaaacgacaaccatgagctcaacaaaactgcacccatcagcttcaaacatacagacagctcttggtgttcaggcgtccggtcaaagatctccttgagcttgcgcagagctgcctccagaggctgtcccttcttgtagtcaatctggacctccttcaacagctcctcgatctgcagcttgaagatgttggatttgaacaaatcagatgattcctgtagtccttgaatctcatcgttggtgggtgccttgtagagcgaagagtttttgacgcccatggggtgctgaggatgtgcggtagcgtcatgctctgctgcggccatgaattcatcctgatcctcttcaacttcatcctcgtccgcagagtcgccgcttggcatatcctgatcctcgccttcaatataatcgccctcctcttcctcgtcgtcctcatcatcgtcctcatcctcctcttcgtcgatcatgtcatcgagctcttctgcagaagactctgactctggctccaccactttgcggacctgtggttgtagagaaaaagggccatgcgagatattgtgtttggttagcactttgtttgagggtggctgcaggaaggtgtgtgggcccaaatgcaagtagctttgagaatgtgaacgatcagcagcaaccgcagcgtgcacatgccttcttggccacaggtgcaacagcagccttggtctttcttttgacggatggtgccatggggttgtgtaatggaggtgagggagaaaagatgcagccgacgtgcaggccaggtcgctgcaggtgtgtgtatgttctttttttttttttttgttgactaaaagccacttgtgaccactcttcatttcacacttcaactttgtctctctgcccttggtttatactgcaaacgctaggtttttgctgcaacgctatgtatttacaatggtatcctatgtttcatcttgatcctgttgacgatcttgcactctcagctgccattctatctctgcaccaccacctcaatgggccttcttgcatcaacgcctccagatcctgtatctctgcccgcggaccgcccttctgacaaggatctggatgataccatttcagtaggtcgaactcctgatccttcctcagacccagtgtttggtcgcactggtccagatctgaactcggctagcgatactgctctcgggaacatgaggcctaaaagcgactgccgaggcagcgcaggcgtttccagttgaggcatctccaccaagacccacttgaggtgaatccagcagcaaaaaaatccatagcactgcagcatgagctagagaggccgcgttgttccataatcaagtgaaaaacggaaagctgttaaggtgatgatccgcgggggagggaaaaaaagaggataagagtacgagggacttgggcgtttttctcaccataaaaaatcttgcgcagtaaactctgatgatggcggcctcatccaacgtgctcaagtcctcgaaaatggtcaggcccagtatcgttcgcacaaactcaaacactgaatcgagtcccagcaggatgttgtacttgctcatccaacgggtcttgaactgggcgcgcgcgcgatgcaccgaccggggagaagaagaaaaaaaatatatcagtgtcaagtaacgaaacaactgtttatgaggaccccattgcatcatccacagcgtctaaatcataccttgagattggcccagaaaccaacgagggcttttacaatcatgagaagcagccatatcacatagatgtactgtgccgccatgtacgcagggtctttgccctgttgagtgccaagggtcttgagctggtgcacgagatatgccgcattcttgcagaaatcaaggatgatcaccaacaggaccttgttacgacacatccaagggaaataaatggtaagatcatctgctcccgtagacgacaatcaatcgctggcgggatatatctggcacattgggggagctgatcttcatggctccctgcagtgtactcaccccctgcgtcagtgggataacgaagagaaaattagagtggaaccgccgtgcttctaccatgacgctcttcaggtgtgttcgcagttctaggggaggggggcgaaaggtctgcagctgcagcgagataacaaaccggagagtccggtgaaagtgagcgccttctcctaggatgggaaagcccttggcgaggtgctcagaaaatatcctagggctgtttggaatcgcagcactgcaacacgaatgagggaaggtaatctcggtgaaacccagatatggttcacagctctgggtagcggcgatgcaaggaatgaaatgagaatggacaatggcgagagaggaagactggagtcgctggaaagatgaagcgcgccagcaccgcgatgggaatggaggatgcgccgagataaaccttgtgtgaggaaagtgcgaactaagcacaagcaaaaaaaaaaagtgggtgacaaaaagtcgaaaagtggggtcgatggcaccaggcagcggatggagcaggcaggaggcaagggcggtagaagagggaacgatagacgaggaaagaaaggtacagaagccgcaggaaagaacaagaggctgtaaaagacgaaaggaggatgcaaagaacacaacggcaaaacatggtgatcgccttgcgcaagaagaataaatcatgcgcgatcacaaaccttggtcagccccagcccagcttcagcttgcccatggtcacaaagggcattgcctcgaggctgcactttctgttcaggtcaagcgtgtccattgtacaggatgtaccctgcgcatttgtgcccttggcccttgaccccagattttcccaagaaaggcagcccacggctcatgctcacgcgctcaatctgacatatccgattcctcagtctgcacgaggtcgcagaagcagaaatcgcgggcaactttcgtcagactttaaatgcatcccctccttacatgtgtgcttcgtttttgtattatgaatagtttctgatttgtttgttgatagatttttttgattgtgctcgcatgccgttgtgtggtatgaaatgctcctttgatccaaatcgtccttcatcctccccaacctcccacctccctgagatatagtgctctgtccctgtacctgtccctcctcggccctgtgtgaagttgacgctcattctccttcctagacattcttgctctccgcgatcctcatagtctccatctcgcgcaaaaacctatcaaacaataaaaggagaaatgtgacatgctttagagctctgcaaagtgagaaaccttttaacatgtcgctcagaaaaaaaagcaaagaaaacgtggtaaaatcgccttacatctggatggcggcaaacagcgcaacggcaattccagtcaaagcaatgacatgtccgttgcctccagtggaaaaaatcaaaaaagcgagtgagaggaaaagaagcacaaagactgcgttcatagccttgatcagacccgggttgactcccttctcaaagatagaggagatcacgccaccgaccatgtccgatggaccgtcattattgaccattttcgctgaggccgacttggcgtccttggtcttgatctccgtggcacgggatgccttcgtgggtgctggtgctggtacttccactggcgacgactcggtcaaggacgcggcagatgtagcggccttcttggacttgcgcttggtcagtttcggtgttgctgcctcgaccgaggatgtggacgagtcctgctccttctcggtcacaacagtggcaagggtggatggcactgaagatactgctcccttcttgctcttcttgccctccaagcggggagagttggcggctgatgcagagttggagctcgactttttcttgttcttttttccactctttggcttactggacgctttggcggcggcttcgcgttgttcctgctttgaccgttcagtttcggaggcgcttcctgaagcatcctcgttgtcgctctcctgctctgcaatgtcatcttgctcgaggacatagattgacatcttggactgaagatcggctgcggctgaggccgacgactgctgggaggaccgaaccttacgactcttcttggactttgactgctcctgccactcgtcgtcctcctccgagacctcagtctgctccttctcagtcaccgcatcctttcctgacttgaccgcatcctcggccattctctgtgcctcggcttctgcctctgctctttgtgcctcttgtgcaatcctctctgcctgatcgagcgcctgctgctgctgttgttgttgttcgtgctgttgttgctgcagctgctgtgccttcaaaagggcctccttgtccttgatctccttctccttcttcttcttttcgtccttttgcttcttggaagatgcagcggccaattccttttcgttctgagcacgagccaacgccagctcctcttgctgctgctggatcttgatctgctgcttcagcgcctcttggtccgatcgttcctgctccagagccttctgaaccagagcctcttcgatccgctgttgctcctccagctcgatccgagcagcctcctcctcctcggcctcgagccgcttcttcaaaagctcatcctgacgaagacgttccctctcctcctcttcctcctgtgaaatccgatctagaatctcgctggggtcctccgcgtcctctgtgtcctggagcagatcaaaataactcgaggtggtgacaccgctggatgcgttgggccgcttactggctgggaccttgctggcgcgggctgtttgctttcgagagaccacgggctggaactcgtccgtgccaaagatctgcttctttttcttcttggagaccttctcgaccacctcgggctggttgggtgcagaggcgggtgtgacgggggagctggtctcggtctcgacttgatcagccacaggggcaggagggatcgagggtgcgaccacctgcactgtggaggatgaggatgcagaggatgctgtggatgatgacgagttgagagcgcgctcgatgaggtcggcggtggcctggtctgcagcgagggcgaggagcttttgcctgtcctttgcggctgtagagatggacgagacgacctgccagccgtcgtcatcgtggtcgtcgaccatctcgtggtgttcctgggaaggcgtgttcttcttgactgagctcatgcttttttttttcgttgatggatgtggctgttcctgacgatgacaaggggatgtgagcgacagtgggggtgtgcctgtgggttgagtggcaggctgcggatgacgagtgttgatgacgagaaagaacaaaaagaaagaaaagaacgaacgaaagtgcgaacaaagaagaggtaggaaaaaaaaaaagaacaacacacacaacagatgatgagccctgatctgatggagatcaggacacaacacgctccacgataggtcgagctaaagcggcctgataacgagcgggcaccaggccccctttcttctcactcacagtcgccagcacccggcactggctcgcctgccatcctcagtctctggctgcagcctgcaccttccgcaccttccgcaccttccttgcagaccctctgtctcgccatctcggtcgacattcgctctcctttgtgtgtcagcatacgtcgagtgcgatcataggccggcacaagtgtggacaaacgtggcgactttgctgaggcccatcacgtgcgctctggctctcttgccccgccggacctgttccccacagggcaacaagacgtgcagctttgttcccacactggctttccaagtttccattcccaccattccgtccaacgccctgctgctttctgccgctccgctctcgtccctcctgcttcagctcagtccccttccatccacaaacacaacagccatgctcaggtccatcctcatctccagcaaccctctcgcacgcgtggctcagtcaactcgcgtggcccatcgcgcattctccgcctctggtacgaccctcttcctgctgtcctctctccatcacacacgctcaggacacgttccttccagcgttctcgaaaacactctgtctttgttgtcgctctctctttcttgtgcttgcttgtgcttttattgtcccccttcccaccaatgccttttttcttttttttttttcttctttgcttttctgacttagcggcctcgaacgccaagaagcagtttatcgtcattgctcgcgactatcaggatcccgaggctcagaaccgccggttcgctgtccgtccaaagcatctagagggcgccaaggctctcaagaagtccggtgccctgcagcttggaggagctctgctttccgaccattccgagtctggaaagatgattggttccatcatgatctttagcgcagagtccgaggacgaggtcaagaacacgatcgaaaagtacagtatctcaatagagctgattgggcaccgagaggtgtctttgttttcggttgtttagctgaatgctttgattgggagtcaaagtgtggctcaccagagtcttcgtcttctattcttgcaaaacattcaatagggatctctatgtcacaggaaaggtctgggagcattggcagatcatgcctttccgtcaagcacccattgagtaatgtaaaacaagaaggaggaagagtcgatagtagtgctttgggaaaatagagcgcagacaattgtaaaggcttgatactagatagacgcacgaaatggattaggagaaagcagacacaaagttgagcttaacagacaaacatcttctgtcatattttaagagaataatgaaagctaatatgtggtgcctgaatccaagggtgtgtgcaaaattccgactatgaatcacaacattttatctgggctgcttggtcataaaagtacagaaaacgctgatgctacaaagcggccgtagttcgctctcttttctcttttcaggcttttttttttttttttttttttttttggttacaatcaagagaagagaagaaagaaaaagtcattaaaatctaaggcaggaatgatcaaagggcgacgacacaccaagttctttttctatccaaccacttccaccgtccagtcggactgctcacgatcgcgcgagtacacgaccttgtatccggtccggtacgcaatgccactcgcccgctccaccatcaacaaatccaactcggctctcgcattgccctgaccatcatgcgccgcgcgcacctcacagccataaggcagctctgcctcaagacccatcggtcgcttcaccatcttgcgaggcttctggttcttgagcgccgggttcatcgacgcgggcagatggctcccgccatagtaccgtccattcgcagcattgatcagcggcgcaggcttgatcgccaacgcggtcgtcgcatgggcgggcttggtcgcaatcttcggtaaccgatcctcaagctgggcactgctcttgtgatgggcgtcgtggtgctgctggtggtgatgctcaccgtcgccacctctaccctcagcctcctccgaatcgctctcggaactcgaatcctcgtcgcggacctgagccagtgcctcctcggacaaaatctcgttcaactttcggcgacgcatacgaataggtccatgctgagccaaccacaactgcaccggtccctcctcgtccctcatcggctgtcggacgtcctcacagcgtctgtacacatactcggacaacgtgagcttgcgttcatacgaatcctcttggtgcgtattagtcagacgcgactcttcgtcggccgtcagtttctcaaagacgttcttgacctgcatcgtcatcgtgttggagcgaggattgtactcggggctggagagaacagcaggcaccttactgggatccacgtcgctatcgaccgatgcgggaataggcccgaaataggtgtaatcaaacttagctgcaagagagcgaaagagataaaagagacagacgaaacatcatggttaatttaaaatccaactccttttagcaataacaacggctgtagcagaagcgtaaccacaacacaaaaaaaagagcaaaatagtcttaccaatgccagcaatggtccagcagacaaagtcatcgaccgcaacacagtcttgacccttgctcacgcgccttggcatgctgttggtctgaccattgtaaagggcctcgtcctcgttcagctcatcctcttcatcatcctgcgcatccgtcatatccatgatcgaagccttcttggacgacgtgcggtactcgagcaggggactacgatccatggcagcctgcagcggaatcttgccttcaatcttggggctgccaatcgaggacgcgctcaggtaataggctcgaccatcctccggatgaactcgctcaggatgttccagcacaatcttttgcatctggctcacgggcccagtgcccgaacgcgacaccttgccattctcgaccttgcgaatgatcagacgatccgtcataatgcccgtcaagtcattgatcagaacaatctcggatccatacagaaccggctccgagttcgaaaacacatacacaggctcctgctggagctgctgctggtgccggaactggaaattcgacatggaaggcgagtggggtccaccgccgttcgcatccgaggaccgaccctgtccacccgagagcgagttgatcatggcagccgaggaaggaggagcacccgcaccggcatgaccggccgttgcaggtgcgtcccccttcatacggatcgggacaaacttggtggagtgactcggcgccttaaagacacccatgctggccggcaccactttgacgggcggtgcgggagggggcttcaccatcttgatcgtgaacgaagaccaagagccgatcttggcgcacacagcattgttgtcgacagccatgtactttgtccgcacagtctgtgcattgatccggttcagaagcgagacactcatgccgttgaggataaaacacgaggcgttgcccgccttggcagtcttcttggagggcttggagatgatcgggatcgggttcgagtccatgatggccgtaggcatgttcgagctcttgttcaaatagacctgaagtccgagcttgaagcgcttggagctatcggagcccgtgccggtcacatggaggttcctgaacgagcaccgcagcatatcgtccaacgagcagtcttgctccatcaggttctcactgttttggtggccattgaccttctcgtgaatgatcgacatggtcacgtgaggctgttccgcacggacctgcttcgcgttcactcctgcagacacctggaccataggcggtgggcacaagtaacgcttctcgataccgtacgacttttgtgcgatcgctccatgccagcaccggattgtcgtcatctggtaacgctgcatcctcgtcatgggatggccgctcttcttggacagcgacgatggcgactgaggcgagccatggaccgacacacccgcgctggagggttgcgcttgagtataacgaccacggcgcgaaagaagatggagctcctgggaggtttcatccacagaatctgccttcaactcggtaggcgagacagaggcatgtaggtgcgcgttttggcggacgggggaatgctcgcggccccacttgcgcttcccaccggtgtgggcgttaggtggagatgactggtgctggctctgaccctggtaaagctggtgaggctgctccctgggatccatcttgatgtacacctgacgatcagatcgcttacccgtagcatgatgtgcgtctgaaagctgagtggatgtgggggaggtggggcttgtcgaggacatgggtgcaggggcgatggaccggggctggattgccttcggcttggcagattgggggccattggcgtgctgagggtaagaagaagactgatggtggtgctgcctaccgtagccagggggcctttctgcgggtgactgagcaggggaacgagagcgccgtttgtacgaagcgcggtgctgctgaggagagacagctgctgaggacgcgtcgggaggactcatggccaaatctgagtgaagatagggtgaagaatcgttggacgatgagctcggcctctggtctggcagcgccgtgtagagggagggcaagcgagagctatgttctgactgtggatgctgctgctggtcgtgctgctgctgttgttgttgctgttgctgctggtaagcatgttttgaaccaaagcgatccaacgcgtcgccgatgggtggaccatgaccaaagttaccagtagtgttactaggcgccacatggcgtgcggaggagtaatagccatgcctgtcttcacggtcctgacttgtcacgttgcggaagtatcgcatatgacgaccaggaaggtccttgcggtaaaagggctcttccggtgccacgataggtggcaggtggaatttactgatgtcctcagctggacggtctgacgactgagcaaaagggtatggtgattgtgaaggaggctggtgcttcaagaacccagaggcaggatcgcgacggtattgatcgtagtgctggtgctgatcgtgggtgttggcgtggtggtcagatgtcaggaggtggtcattgtgatccctgttggtattgcgcacccggccctcgtatccctccgtgtgcctgaccaccgattctgggcgatcgttggagggatacggttgagggtagtgagaagggcgatggtcctcgttaccgcgcgcgctgaagtgagggttgccactggtagaggatgaaggatggtatgggttctcgtcgcgagcggtatattcttcccggcgctgcctagaatggtattcatgcgatgcgtgggtgctgtgtgcatagtgcgattgctcttccctttggcggctttgctggtatgcttcatgatggcgctggtgctggtggtgctgtggaggataagggtgttccatgggatatgaggaagaggaagcataggggtgatggggtggggaagactcgctgcggtgcgctggggcagagtgatgcgagggatggtgacgagactgatgttgctccatgggtgggtatgaggaggacgaggaggaggaggcaggcgaggaggcttgctggtagcgagagtgatgtagagaggcggagtgattatagtaagggtcgtagcgtggcgagtcgactgccgtcgaagcagctgttgcgaaagcgggcttcatgccgtctatgatagggacggaggtggcgacaagtgtaaaaatgaatgcttgatcagtgctctggtatgctgatgggaacgattgaatgactggagagatagagcgtgagaaggcccaaatgaaaggggggcaaccacggtgaaggagaacagaacactcgagggacgagcggccaggacgacgagaggcgagagacggtcgagtgaaagcaaagaggggtaaggtgtgatcgagggctgatcacacgcgtttccggctacacaaatccgattccaatagaacacaggaaaatgaagagcatggcctgaagtccaggcaatggacgtgaccagcctgaccttctgatctcaccccctcgtccacctactcttgggaggcaacaaagtctcagggcctctcccgatccccacctacgcactgttactgtgcggcgtgcaggggctgggtggcaaggagagtgaagcggagcagacccagagaagaaaagaacggaagaacacaagaaaaaaaggagtgtgcaaagaggtaacaagatgaacgaatggatatggggagggacgacccagcccacgcccatcgccaggacagggggaagcactaatgggccaaggatgtgtgtgtgtgtatgtgggtgggtgggaaatttgatcatggtaaaaaggggatatgatggtggttcgaggacatatgcatgtggatgggaaacgagacaaacgcgagagtgcgctgatgtgaaaagcccctggtctccttcgctttgacccctcaagtcctgccagcacactgtgctgctaggccatcgaacttgagcgacgaaggcaagggcgaaaaatagctgtgaaaggggcggtgcatgttgcagacgtaacaaacaaggcttgatgcattaaaggcaaaaagaagtgcttgagagtcgagacacatgatagacaacggccaagagggcagccacaagcggcccgcgcgggagtgaagtgtaggaaagttgccgtgtcctgcctggaggaaggatgtgtgcatgtcacttacgatatatgtatggggggtgcgcttttttttattcggaacgaaggtccaggaggaggtgcgtctactgtgtgcgatgtgctcgagcaaaaaaaaagaggagaggggggcagtcaagagagaggaaaaggtggccgatgcaggtttgtgatgagaagacgagaagagagagtgcgatgaagtcggtggaggtgcttgaggtgatggtgtgctggtgaaggtgatgatgatgaaggcacaggtggggcggatgccaatgagaattagaaatcaacgaaaaggaacagaaaagggcgaaaggagaaaaaagaagagaaattaaaaaaaaaaaaaaaaaaaaaaaaggacaggttggggggtcgaggcgtgggcaataaataagcaaaagtggaaaaagggcctcgctgctgctgagaaaaaaaagcgacgatacagaaaaggcggagaaatagaacagtacgcagcaggtgccacagtgccattgagccagtacaatactcaactgaattcagtcgacgtgtccattgcagacaacattcaagagtaaacaaagaaaacgagtaagaaaaaacagggtcagaggatacagagagtcgaggaatagagtaccgcaccctccattctctatcagcaaacactcctttcgcggacattttaggccgtgggcttgttctggttgaataccccatttgagttttttctctcttttttttttattttcctatcgctctcatctgcggtctggaggtgtacagtagcgttggcatgttatgacaaccaaattaagagcacatctttaggcaaagcctgaccgtgtgaagagcgcaacagggtgggtaagcaaagcgagggcgcactctgttgcgccttcgtttttttttgttctctaattttctttactgcgaccgcatggtcaatggcctggtctttgtctcgatgcaattgtcggacaatttaacacacaaggacagatcaacacaaacaacatcagtaagagcgagaaacacggcctgacagcagaccggcgcagccctcacaaaagaccaggtcttcataagaggctttgtttatcctcccatcggtgcccacgttgccatattttgtttgttgtttgcccttcttctctttcactgctgatgctgctgccgctgccgctgctgtgtgtgttgctccgtgtgttgctgcgtgttctgtttggaccgccaatggttgctgctgcagaccgaccaagcccgctatttattttccgcagaccagactcattgtcgtgccacttgaatcgcgacctgtctctcgcattcccccttggcttgattgcgcttttttgctctatcgaatcagcacagtaagatcaacaacaccccaagaactgcaagtacaatggaaccaggaaagcgcaacaataacaataacaacgacaaagaaaagaaaaactttccgagtgacacgacagtgcctcgtccacgggacggctatccaacgacaatccatgcaaaaaggccaggggtgcatatccccatttgatgacgagcacgggcttatggccaatccaattcctacaagagcgtggaaaaaggggggggaaggcgatggaaaaaagcggccgagcccattgggctgggcttacactgtttgttcccctcacgagtccccccgtcccatcgtcccctgcgggtacccaatgcaccggtactggaaccaattgtgagagtacctccacccctccttcccttgtctctcctcaaagccttcttttttggtctgttgtctggaaactttctcaagaccgcccggaaaataaaacaaaaaagagcttgacgagattatgcgaggtcatgtctcgtcctctccctgtcgcagagtactctagttcaaagtacagtaaaaaaaaacaaaaagatgttgggagcggaaaattatttggctgctgtatttgtaatgaaccttgccaacaacactatcgtccacatagactactagcagagagctcattctactagcaggagggccactttcctgagaggctatgtaacgaccccttgttgtaaaactatgcatttacttgactcggcacgcgggcgacccgcttatttcccttttgcgcaaagagctgaaatgagcctatcgcccaagcgtccatcaaagcaagacaaaaaggaaatgaacaataacgctctggggccgagaccgggaggattgttcttttcccttcgggtcatgacacagcaaatgcccaagcagctggtcagggcctcaatcacaggcaggccacatgtctcgctatcattccttggcgcgggccatcctccacatctgcttgtgcagtggtgaaacacgccagagaataaaagcaagaaagagaaaagaagcctgggcggcgtctctccgtttcccaccggcaccactgtggagatgcggtgcgagtgtgatcgaagatgagaggctgctacaaaatctcccattggtcgaagccgccgattcaactgggccgcgcgagcaagaggacagaaagaacactgacaagagaaaaagagagttgtcgcgccggacaacagatttattgagttcagttgattgcggtcataaagtgaatacatttcctcgccacaaatggaaacgatgcaagagttcacagtgtgtgttgtgtgtgtgcacaaacgaatctcagcacaacgcaaccttctttctctcgctttctacagtgactgaatctatccctctctttcggggttacgcgaaacaggatcgtggcggaggaggcacccgttgctcttggagatttagcctttggccacttttcccttcaggagagaaatataaaaaaacaaagcgcgtctctgcaactttagccctcgtgaatcacatcagtatgagaaacaaacagctggcattagaagaaaaaaaacgggagagagagccatccgttccttaaaaaaagaatccctctcccatggacgaagctatcgatgtgcgcaacaacctgcgcatgcctgtccagtaacacaatcccacagcaccagcgtcatgctaatgctcgtgagaacgcgcttccttgacacaaggagaggcacttgccctgaaatggctgcatgtgtgcgcacaggtagtccaggtctagtttaacctgaactattctagttcatgacggcaagattgtaattggaccggccatttgcctccgttccccttccttggctgcgcacggctatcaccaccacatcgccccttgtgttgaaaccactacaatagatggctcagcattgttgtgaagacgaaatgcggcagtgtaaattggtcccatctgcagaagaatccctttcgaacggaggcgccgttatttttctttggactctgatgttgtgttcaagatgactctatttttatgttcaaacgacatgcccgacatgcccgacacgaacggcggctgtggtcgcggaataatcatttcatcgtgttcaacccgtaggcggtgatactttcaactgggagagcttgaataaatacttgactagctgcaaaaccggccaccccatccgtggcatcaaaaactttatggcattaccttttggtttggcgtgagcaccattttccgacctcttgaagagacaaggtcgaggcattcaaagctgtatattcagtccctcacatgcatttttgatttctctttgtacatgtacagctgctttaacagatttcaggataagagaggaggaggggaagggagggaggtgcgaagggagcataggagcgacatttccagaagcactatgtattctatttggtgtgaagctctcaaacaacaatgtggacccgagaatgtatctcagagtggttgtgtacctaacggagtatacttgaatgcgctaatcgatcgtcttttcccaggacaagaaaagcctggaccaactctcggcagcgcttccggaggctgaatttttttttttttttttgttgattttcaagctgttgttgtccaatttcgttgtgcatcaacacccaggggtgcaagagggtgaattatgtttagcaaaaagactcctgccttgtctgtctccaccccccgcccccttggctcttatttacagcccttccctttcgctcctcgggtcatgaaaaacagcagagaggggaaagagagcagaacagccgtatcatcattggcgcctcttaagcactcactgcaaaaccaagtgtgtggaccaatcggggaaaagactgcaggtcctagtaatcatccttgcgcgatcacgcttgcagctcattgctgccaaatgtccctacccctgccgaaccgtagacgcgtctatacaatggcgtacacatcaagggttcagggaacaaataaatttcaggaagccctaatgtgtattcaacactcgcaaaggatatacattgtacactggggctaaggaaaaatgaacgggagccgcactatcataagaaagagactgatgaaaccatcgctcaaatagcctcagtctctacacggatattacatgatgaaatagaaccgcgttgacgtactcaagaatcaagatgtggcgcaatgggcgtcccaggagaaaccatggtccaagtgttcccgtcgctgtgtatctcaatctgtgcagtagaaagaaaaatgcctcaatcaaatcaaatcaatcataaagccgaaattgaatcgtctatacagcggagaatgcatctttaagcatagcctacggcatagactgccggcgtgaggaccgactattcctttttgttctttctcttctaatcttctactatggtgttgtacacaatggattcaccctctatgcacacccaacagacgttatccgacatgtgtggtagtttatcttgaaggggtccttatgtggtgaaagtataccctcggacttaaaacgcgcaacagagtacggtgcggcgtactctgtgcccgcggattattagcatggctaagtacattttcgcagtttctaacaaaatggatggagtagactatgggtacagtactttgctgtctctttgtgagatgtgagattgtatcatgaactgatgatggacaacgggttcgacacacacaatatgtcaggtttatgttctgagcactatataggtcataagtcgacttcaacccctcccatcccgacatagcctatctatctagtttatgcacgcgcaagacaaacaacgtgcgcgacatcaaccccatgtcatctcaatttttacaatccacacatcatcgtacccattgtaccactgccctgtactcctttttgtttcgttcctgaatttttctttgccaaagaaatgtgttacagtctaccggggggggttttttttttgagtcccgagagttgctgagaatttgctcacagttgcccttggctctcaacagtttagaatggaggggggattgatactgcattttgccgttgtgcatcttttcccactacgctcaactgcacgtcagctttacccaattgatgcatagactgacaaaccctttttgaagtgccaagaaagcaaataagaaaaaagacaagaaaaaaaaaagcccttttggccacacacttgtctctataattacattgagcacccagcacccttcataaaactagcacgttttcttcccgtgtgtgaaaatgcaaccaactttattactgcaaggtggtctactcaaggcatgaccacatgtagccgtatgtgtatagacagactttacacacttcaaggacgaggaagaaacatagtgctcggcagagtagatgattggatgaaaacaaccttcgcacagttccaaatggctcaataccatcatcgattcatcctccatctccttccctcctacacagcatgcgacacagaaaaactatcgaaaaagaaaatctctttgttatttgtttttgtttacgcgaatagactagcatgcgaaaggattacccttttctcaacatcaaagttgccatctacagtttggagaatgagcaaataagtaacagaagagccatacagggtacgtagtccaagagagagccgggacgccaagacgaggacacatataacaaactcgtccggcgggtgcatcacaaggacacgcctcgatcacgcgaaacctccctactcacccctccctccctcctgcctcgccagcagcgaccacgccctcgacgcagaaactgtttgttaacaaggttaatggttattgacacctatccaagcattaggttaagtcattcatgaacacctccatcgtttccaaaataggccaaatcaagctttgcgacctacagtaagccatccaacttatggccaagcatgaagaaagcagaaaatatgacatgacaactgatctgaatcctacagtacctgttcagctgggtgttttttcacccccttccgcgttgtctcaagctgccgtaatcgggtccgcagcaggtctccatctgagctgtcaattgctctactatcgtaatcttgagcacgagtacatctctttgtcctgaacaaggcatacgttttgggacataaacgtaaaagctatcgtgttttggctgatgggctgcactctctggaatgtttcgcacacttcatctatacaacaccgatgaccttggggtctcaatccatgcactcgacccatattcaaacccatgcgtgaaaatgacagaaccgttttgtgttgataaacttcatagcacagtcatcaatccaaaaggcttactgcagcatccacctctctgtgtgtactgtgcgctaatgtgttagttccaagttcagtgctccctgtcagtcaggcagctactcaaggatgatcttggagctgacgggcccctcgatccgcgctgcccccttgcgtctgcaggcaccagcgcacctgatcgtccgagaacgaatacgacgatccgcatcaggctgttggttgagcgcggcggatagaatcccttgaaactatcaatcgttttttccattcttctgacaagatgctgtttgtgtagtcaagagttgggaatagaactgagccgaaacctcgctgtcatgatgcatgttgatattggtatcttcagaacaaatgtaacggtccctcttttctttttcttctcttttttttcctcttccgcacgcgtcgaacattctacggcggaggtttggatgtagttatgtgtcgtaaagtcataaataggcgttgaaagtcctaaagcgcctttttggagttggggttgatcctccgctcgatgccgggaagcatacgaggacatgacgaaaaagggttttgagtgaagtacagggaggccttgtgccgatgcaggttgaagggggtttttttattatcattttccaaaaagattgccgacgtgattatatcgctatttagccttgttggtcgcgtctagactgaaataggcatattttatgtgtataacacataaacccttcatactgcctgcctctcatacgctcaaactagtcattgagaaatccatgttggcttgtgaatcgcgagactgtcgccgctcactccctctctaaagggacgaccccatgctaagcgcaacgtctcgagcctctgcagcttccctagttgagcgtacgcctttttgatgagctctcgggtcctaccctcctgctgcagatgttgcttcaaagtgccctgctcgagccgctcgtcatggatatgcgatactctgttgacgcccctaaatattcaccctaaacctgtgcacctggagccagtccgtgctgctcttgtccagcccgctgatccgagcatgaggccacgtctgacatatccattccagttcttcagtcccgacggaaatatgtgccataccatccagcgagagctggctgagggaccccaggtctttcagcagtgctagcccactggccattgaaaagtccatgtgcacaagaggccctggcttgtggatcgcgaggctatcgccgtccactccctccctgaagggccgaccccaaccgagatgcaacgttcgcagttgcttaagcttccccagctgctcataacccttcctgatcaactctcgagtacgcgcctcttgttccaaatgctggtccaaggtatcctgctcgacgcgctcatcatgaaataggaggcagagcgcctgaagtccaaggcaggtccactctgactgagcaaggtgactgagacgcaacggagagtagtacggactaatagtccatgtactctcctcaccatgaggacacatccaaaatgtcaccaacctcgggcacgacgtcaatagtagttgtatatcagagctctcgaggatggcgcctgctccgaaggtcagcgaagtcagcgtgttggaccactttgctctcattcgggagacaaacactccaagcgtgggagtgtcgatcgggagatccaaactggcgagactaggaagggcctcgatcaccggcaagagctcatcctcctccaggtagccaatgatggtcagtgcgttcagctttgggcagctgtcgcgcagcacctcgacaatggacgaaagatcaggtccaggtatgacaggaaggctgagacgttccaaaagcggacattttcgcagcagtgggaggagcaccaacgtcaggttgaactgctcaaattcactaaactcaagttccttcatgttcgggtatacggccggccagtgcaggttaaacccacgcagaaagctgcccgagtcaaggatgtccctgctttgcgtgaaggattcgtggtaggtgaccctctccaccgaggctggaagactcgccagaaggagaaacaagtccagtccgccaaatcgtcccgcggtgtttatcgaaatactcttgagagctggaggcaagaatggaagcaggagcgtaaggccgtgaatattcagcggtctatcctcatcattgttctgaggatcatcgtctcgggacctcagcgtgaggttgctgatcttggtcccacgtcgtacaaacatcgcgagtgcccgcgcatacgggctggactcgtgctcaagatcgcattccaaagactcgagattctcgcagaaggttggtgaaatcgttaggcacatgagcggggtgtaaatcttgttcaccgtcaactcatggatccagtgagcgttggcgcatagagtcctttgatgctcgtgggtgatggcctcgttgtcctgggtgtgtttgaacaccagctttctccaaatgtagcgtttgcacgcgtggtgaaatgctgtgttgaccagagagacattcggatagtctcggcgacgaagataacaacagatggtgtcgacgactggtggcagatcaaagatggaagtggtagatgaagtggacatgggcagtggacatgggcagtggtttggtctccggtgtgattgggcgggaagtgaaggagggggtgtgtctgagagctagcgcagagtgcacaccatgtagtggaataatcagtcgtctttaattcacttcacacatcttaggggttgctgcaagttcaaaccaaacctttgcacttgtagccagtctgcgctttttctgtccagcccagtgatttcagcatgaggccatgttccctgaatccactccagctcctcgtccccaagagagagtcgagccataccaacaagcgaaagctttttgagagaactcattcccttcaacagcgcgagcccgctagccatcgagaaatccatgtgaacaacgggacctggcttgtggatcacaagactgtcgccgtcctctccttccctaaagggatggccccagcctaattgcaatgtctccagcctcgtcagcttccccagttgaccgtaagccttcctgatccactctcgtgtcctctcctcttgctctagatgttgctcaagcgtgtcttgctctacccgctcatcgtgaaatatgatgcagagtgcttccagtccaacacatgtccactctgactgagcaaggtcactgagattcaacggagaatagtgatccgtcacagtccttggattgtacactgccccatgaggagtcatccaaaggctctcaaaccgaggacacgatgtcagcagcagttgaatatctgagctctggacaatgacacctgcccctaatgtcaaggacgtcagcgtgttggaccactttgccaccatttggggcatgaaggccgcggtgctggggacgctgattggaaggtccagagtagtcagagcagggacagccttcaccatcggtagaaggtcctcctcctgcaggtggccaacgatcgtcaggaaccgcaggttcgagcaattaccgcgcagtacctcggcaacggattgcagagcgggcccaggtatgatgggaagcgtgagacgtatcagtcgcgggcatcgttgcaaaagcggtatgagaaatggtgtcaggtcgtagtgctcgaactctccaaactccaaatccgtaaggttcgagtagacatctccccgccaggcaacaccgtttgctgacagagcataaggcgcatcgtcgacctcattgtctcgagggtagtgctgcatgaacttgaagcccttgacccactgcggaaggcatgttagaaagaggagcaggtcaatatgtccaaatatccctggggtttccaccgaaagatactggagggatgcaagatacggtagggccaaagccacttgcttgattcctccaatgtttggtagctgctcctcgtcgtgaatctgaaggtcctcgtttgagaacccaatgcttaggactatgatatcggtgttaagagtcaggagcttcgcgagggccttggtgtatctgctattttcgtgctcgagactgcattccagaaccctcagattcctgcaagcggttggggacttggtgaggcatgtcaggggagtgtgaatcttgctcacggtcagattcttaatccaatgggagttggcgcgcaaagccctccaatgctccttgggcagtgcttcattctcctcggtatttttgaacaccaatcttctccaaatgtagcgtttgcatccgtgataaaatgtcttgttgaccagagagacattaggatagtcccggcgatggagataacgacagatggtttcgacgactggtgggagatcaaagatggacgtgaatggagaggtggacatggtgagaggtgttcatgcgaagaaagagatgcagcggagagagagatgaaagtaacaaggttcaacgggccagtggctagcgtgaaattctgcgcgctcagacaaaatttgcttgacacgttgatctgagcgtacggcctcattccctgttgccgttgagctggggcggcagcaagtacgcgtggaactctggaattatcgtcgggctgctgtgcgctggttttttggtcgctgcgatctttatttgggtcgagcggaaggtgccaagagagcccattgtacccatccaatctgtacaaaacccgcaatatctggtccacctacggatcgctcttctttggaggaacggcttttttcgggatcctgttttatcttccagcgtacttacaggtcgtcaagcagcaatctgccatgatttgaggccttgagactgttccttttgctctggggatagtgatcactgcaaccggctctgggatctgggtccttaaaagaggcacatttgcgttcatacccgcgcttggtatgcgttctttgtcgtaggagcagtcctgtgtgtcttctttgaacgcggtactccgcgggttgcaacagcttttgttctcctgatttgcggtcttggaatagattgctctatgcaagtgtgcaccttggcagtgcaagccgccgtccaacccaagtatatggccacggtcaccgccatggtcagttttgtgcgtgctctcggccaagtctttggaatcgccatcgtcggctcagtgtttaataacaagctcgaatcgtgtctccaagaccacttcctctggatccgacgatcctcgaggcgacgcgggattacagacatatcttgaattacaatgagagggaccgggatacgatctacaatagctttgttaacgcgctccattacgtgttctactgcagtattgcgttctgtttgctttcatttgttttgagctgcttcatccagcacagggagctcaaaactatgccaaccagcaaaagccggctgaatcgtcgattgaggcggtctaacatcgatagtcatttaccgaatatacgcccagttatccaggaccctattgcagagccctttgcaaagacaactatcttttggcagcgaagcatccagggcgtccgctgtggcatgtcgtctgccgccggggtgtgtctccgcagttgttttgcctggctcatttggcctgtttcgttttaaggcgaattgtctaagcggaagcgagcgctgacacacagcgcacacacacacgcacgcacgcacgctccgcttttttttttggttctctttctcgttcccattcacattcatcattcacccattgccattcgctattcccacacacactcactccttcttctggccaaggcatcaccgtaccagctccttgcatcgctgcatccgccacccttcctcacccgagacacctcgcccgctcgcatgtggtccaagggaacagctgctgtgccccgccgcaccctgctgctgctcactgtagcgctggtcgccacccagcacctccataccggatccaaccttgccgaatgcacacccctatggcctctgcatgacaacagttacgtcgcagcggacacagcccacaatcacgaaccgcggtcctggtctggtggggcgcttttagttcaggcaccacagtcggacggtgtcgtctcacaacaacacgccttcagtaccgaccaagagtcgtcctctcgaacctcttccaacgaccttgctgctaccagtgatgaagaggactctctgcaggctcaatgcgaacagtttttgaatcaactacccaacacggacacgccaagggctgaaccgcagcttcttcacacgtacagcagtgcccctgaaaactccacctggcgtctttggtaccgcacgccagcaaaggcgatagagcgggacgggtttctgattggcaatggacgcactcaggttctggtggggggagccatcaacgtcgagcggctcgttctgaatgaggagtcgtgttggtctggtgggcctggcgagttcaagaaatccaaatcgggctctgatgacggcggtgacggtgacgaagaaggcggtcatgaggatgaatatcggggcgggaacgtatcagaggaggcggcggcgcagcggcaagaggccctgcaggaattcaggaaggcactgaaggagaagcaagtaatcaagccctcgacagagattgtcaaatctcttctaggagatgagcgtggatttgggagacctgaggcagtaggcgaggtcctgatcgaggaaatgaggccgttcgaaaaggtggagcggtacacgcgcgtactggacctggagactggagtggtcaaggtctcgttctttgtgggcgcagtggaatatactaggtaaaatgtcgcgacttgtaactgctgatcgatccagtcctagaagctgtaggagtgccccaacgctcatcagtgtttggaaaatggctgtcgttttatctgatagggaacacttttgcagctttcccgagtctgtctgcctgatgcgcatcaagagctcagaaccgaaatcggtcaacctcaagatttcgctcagaacagcgcatgaacaacaggcagagtacaccaatgtccataatcgacttggtctccgcacccgtcttggatccaacaacatgaccatcgagacgcaagtcgctgtgaagacggagggctcgaccggtgtttccatggccaacagtcgacaagtggtggcgctaggctttgatgccgtcaccctgtattacactctgggtaccggttggtctgctggcgcgtatcctaaattcgaggaaaaggatcctcacgatggtctagtcagcaccatcgacaaggcaacagcccagtggtttggagaccaatacgacaagcatgtcaaggaccacaaagccctgtttggaacgttcagtctgaatcttggccggctcgagaacctgaagtcgaccgacgagctgattgcggctgctcgcaagggggagaatggcgaagaggaaagctatctcgatgcgctgatggttcagtacggccgctacttgctcattgcatcgtcacgaacgggatcgctaccgttgagtggccacagcagctggttttccgacgagaatcttccccgagactttccaaggtaagttttgtataggtcgcgatgaccgacgcctttgttcctgcaggcactgttcaatgtgtatcagttgtcttgacatttcttttttactactgttagtgacgggtacaagatgaacatcaaccttcagatgaactactggctggcggaaagtactggcttgggcgaaactgtaaccccattgattaattacatggaaaaactcctgcagccccgcggtgaggagacagccaagctacactatggtgcaaatggatggactacccacacctactccaacatctgggctcatacaggtccaacggctcagctcaagtccttctactttccagccgctgctgcctggttgtgccagcatgcgtgggacagatatctctacagccaggactattactttctgcgggaccatgcctacaagctgatgaagggcgcatcgcagttctggctggattcactggtccggacaaatggatccgacgacggcgaaggcgagttcataggcgggaactttttgagctcaccatcttattcgccagagcatggacccttcaccgagggttcggcactggaccaacagctgatttggcaactattcgagaacaccctggcagcgctcgccatcgtcggtgagagggacaagatctttgttcagaatctaaccaacacgcttgcgtctctatcaccgggcctgaaaattggcaactggggtcagctgcaagagtggaatctggatctggacgaccccaacgaggcccataggcacctggggccactctgggctgtatatcctggtaaccaaatcttttcggctgccaacgctactgaaaaaagacctgggtccgaggagctcttggccgccgcaaagaccacgctagaaagtcgaggcacagggacgacagaggatgatcttgggtggcccaagagctggcgagcggccgtgtgggcacgactaggtgatggagccaaggcattcgaggcgctggatctgttcaagaaacacaatctgaagcagaacaactttttgagttttgaggagggactctccggccagctaggggctggtgccgcggtggtggagatgctgattcagagtcgagctgccgggtcggttcatgtcttggtttgcgctgagagtgggctgccaaaccaatggctgcagaagggaagtgtggagggctacaggacgcgggacggccataacatcacggctgcttggtatgattctcgagtcaccagggtggaaatatcagcggtgttgaaggcgggaccgctggatatgacaattgggacgctgaagggcgaggaggagacaccgactgcaaagctccgagtgaccaacaagagctcgggcaaggacgtcctgttcacgcgagagcgcgacacgattgtgctagcgatggtcaaaggcgcgacttttgtcatccaaatcgagccgtgaaccgcctcagtgctagaccgaatgaacctccgagcgcatagctgtagaatgagtagtatctgcttttgcagcacgcgttcgtcgcagtattctaatgaacagttttgaaagacacgtcaccttgtctggcttcgcgttcgagccacccaaaaaaatagttgcggggggtaagaagaaaaaaaaagactttttcttttctccctgtgctcccatttctcctgaccacaccacaccaggccattctccatcgccgtagtctcctggccgatccaatgagcgaacccaccacgaccgccgctgtccctgcagtcgcagagtcgacgcggacaaacgggaaggacaaggaatcgacccagtcgcaggacagcacaccagcactgcaccccaagaagccggccaatgcagaggcaaaggccagcaacggcgaaaacaacgccaacaatgccaacaatgacaacagagacagcaccccttctacgtcgtcagcaacaccggcatcggcatcagcccagtcgcccaaatcccaaaagtcaagaaagagcaactttactcccaggggcggaggtgcgcctgcatcgccgtcaacacgtgcctccgataatgggaagaagcccgcgcgtccagatgcatcctccacttcggccgctgatgctgttggcctgggagtcgtcgctagtgttgggcctgacgcctcagtaagcattagtagtgacaaaggaacggagccgcaacaaaagccgccacagcgcactactggatacactagccgtagaggacgcccctctgactcccagagctcttcgccttcgatcacacctcctgcttcgacctctgaggctagatttgcgaacgcccgaggaggaggatattccggccgaggacgggacgatgacaatttccgtggaagaaagttcgatagtaggcagaaccgtgctccgctaggtgaacgcgcatcgactcccaagactggggctgagcctgatctctcggcctccgcagacaccggtcgtccactacagcaatcacactcgacagggtccagcgacgtcaggaagagcagcggatacagcactcggtctccacttgcgccgcgatcaccacgacgcggatttggtgagagaggtgtggagtcgaggaggaacaatgatgccttggcacaggaaggcttggctgatgcttctcctcaagccgagactggtccatcgactctggctacctcgcagaacaagcgcaagccgaacaggaaaaacaggagaccggaggatgacgatgggtcggttgcttccgctggctccaccaaggaatccgagaatgcgatgggaaatgcggatgcagtcaggagcaacagtgcacgcgattatcgcacgaatcagcagcagcaacctcgtgactggaaaaacgacgctactgcggcgggtaggcaacgaaatgatgcaaggagggatgcatcagagacgggacctgcagcagacgggacatcgaatgcagtcaagaactctgacaagaaggacactggtgatgcccagagtggatggggagatgcacctgctacgaactcgacgcaacagacggatggatggggcagctcagcaaacgtcaatctgaagtggggcgaggacctcccttgggaaaagtcggacaagaaggatacgcccggcaccaagcctccaccggctgccaagcccaagctgggcaggactgcagaacagaagaatggcgatgacactcagggaaggggcaactcgtcggtggaacctgcgacagcaaatcaggcaagcgggtggggtgagcccccaaaaaacgttaatgtggaatggggcaaggacgaaccttcgagtatggacgcgaggaagggtttcgtacccaccaaacatgcaacagccaccaaaccaaagacgaccagagcaccagccgcgaggaataacagcaccaccggatctggatggggcgatggttctacggccactgccaagacgaatgaagctggaggttggggccagcctgagaccacacactcgaagtgggacgaggatccaaccaagactggcagcaacgttaggaaggaagcgccaccggcacgagtgcaaccgacgtcagcaccaagaactctcaacagaaatgaccgaaaagacgacaccgcggctcaacaaggatggggcgctgcgccggaactggcttcgaacgttgcagcttcggatggctggggtgcacccgtagtgaccaacaagaaatggggcgaggatctgccatgggagaaagacgccagcagtgatgcacccgtccccggcactgcgccatccgccaagccccaggcacccagcaaacctgagaaacgagaacccagttcagcgcaggaaggaaggagcgatacgcgtgcgacagactcagccgcgcaggtatccgggggatggggcgaacctgcagttgtcaccaagaaatggggtgaggatctgccttgggaagcagagtcgagcaaagatgcacgtgacagcctcaccgcttcgagcaaggcaggtgtaaagaaggatacgcctgcgtcgaacggacggggagatccacctgcagcggatttgaaatcaaatcaagccgacggctggggtcagcctgcgtccacgaccagcacgtggggcgatagcgtgtcctgggaacagtcgagctccagaaagcaggagagacatcaggagcgcgataatggccactctcagcgcaggaactcatcgcaagacatgcgtgacagtcgcagcaacaacaatcgtcagggatacggtggtttccaagaacgatcaggtcatggacaaggtagacctcctggcagaagcggcgatgcgagatttgaggatgctcggcagcatggatatcaacgagaacgcatgcaggatgagcggcccacaaggcgcttccaagagaccgactctgcttcccgttcccaggacgcgcgctcgtcactggatgctcgcaatgagcgactgggctttcatcgtgcacctcgcagacctgacccactacaggagacgaatgcgcctactgagcaggcttctggtggaggtggggaacgctcaaagccgacagcagagtcttcttgggactcttcgaaaacgtccacgtctccaaaccagcgcagaggactttcaccggctggttctggagatgggcggctcgatgctcgctttggaaatcccaggactggacatggacgtccagacaatgcacatcctcatcgcggccagaggaacgaggggttctcgaatcagtatgggcagaacaaccggtcgtcgaatgccaggtcgtctgagaagcctttgcgggattcgtttgcaggcagagacaaaccagacgctgctagtcaagcacgcaaaggcaagaatgcaaaagaacccagggcagctaaagctcctggacagacacctgtaagtgcgctttgagtttcctcggtgatacatgtcaagtggctagtgcccctgatggaggtgttaatgatactatctttgattcctcgatgaaatgaataataggcgcccatgttttcggattctctcgagtgccaaatgacatgggaggagatggacttgagacccaatgtgctggaaagcatcgccaaggccgggtacgctgctgaaagaatgcacgacgtgtggatcatgaaatcctgatgcaattgtgctgatactgtgtgcttcctctttttcaacctttcgtgctccagtcttccaaagccttccaacattcaaaagttggtcatgaagccattcaaggatggcagggatgtgattgcgcagtctcagtcccagaaggatcgcaccaatactttggccattgctctgctgcagaaactcacgccggctgctttgacacagaagcattgtaaggccgtcatgatatgctcggaaggtatcaacccgcaacgagttcatgaggatcttcaaggctggttcgagacaacgcctgggctttcatccattcttctgagtagtgactctaccgccgagaagcaaaagtcggttctgtcggacgccgaacaagcaaagcaggttgtcattaccacattgggtcctttgatggacgttctcaggaatgatctgcttgatatgaaacaggtcgacacagtggttatctccatgcgatcggatgagctcgtcaactttgatgcgttcaagcaattttgggccatgctaccccgcgaagcgcaggtcattttaatgacaggtaggatccagccgcagatccagttgatcaagacgcatcatttcagagcggatgctgctgtccgcagggctgacgaactgacgatgcagtggagcgagcactactacgtcaacattccgtctcagcgacagcaccgcaagcagcgtggcgacgagaagagtcaggttcgtgatcagtcgaaggatgaccatgaggagccgagcgaggacggggatcaggcagcgacggcgccaccgaccagggacgaaaagtgggaggtacttatggaagtccttggcaagaatccagacatttcccacatcgttattctgacccagtcgcagagttcgacgcagtcgttgaccgccaaactcgaggaacacgaccagccagttctctcagttgtaagtgttgtatttggacaagtgttcttttgctccgcgtcttgttttcagctaaccaaaatcctcctatgcaactatgcactcctctctgtagtggagtatggcagacaagactgatgtcgcacgccagttcaacagaccggagcggtgcatcctcgtgtcggaatcgattttgatggagaacctggatctggaccattcctcgctcgtgatcaactacgagatgcccaggagagcatggcattatatctcctcgtttgggccattcggacggtcgggactgcggactttgatgatcaacttttgtgtgaacgacgatcccgcacagaagcagacacttgaaaccatggagtcgctgtatgatatcaagatccaggagatgaaggtaggagtcatcgccaggaatgaagaatgcgatcttatatcgaagaagaacgtccgataagtctaaccgcctccctttgcgctctcttctctctctccttgctttcatttcattaggtgtgagggcagtttgttgtattttctttttctattctgatcgacctctttcgtgttctcttttcttttctttatcaaccgtctgcaataaagctgaaagtcaatatgataggccaaatttattgaacgattcgcgctaccacctccgcttcatctacgatatggccattttgaacatgcaacgacgttaagacggtttgcttctaccgagtacaaaagatgcttatcataacgatcagaatttcatggacttaccgaggcctgaacacattctttgaaggcaaggaattccttttcgcaaacacccttgtgcacgtcgttcatggttgcggagatgcaagcaccatatgccgatgcctacaaatagcccaccaaagtaagtcccagccagaggtgtgaagaagtgcgtgagttttcagagtcctcattcagaccccttttcgttatcagcattttttttatatattgaaggtatatatcgttctgcagtgaagttgctgtttgcaggagagccgtaccgctggagcgcaggaggctatgctctttgagaatgcggcgatggtctgcttcggttttgacatggtgaggagtacaatgtgaagtgcgtgcagtaggttctggcacgcacaaaattgtagcgtgcctgcacgtgacaccggcctgttgcagcgtaggcaagctacggccttctttcaagccagcagtgccggataataacaacaagaggtcgcccatgcagaaacggcccccgcgcatcaagcaaaggctaaccgtcatccatccttccatgcacgctcgaagcacgcggtctcagggtaacttactgcggtagaatcatccacctaccgccttgagtgacgtcatacctttttttttttttgtgtggcccgcagtccacacctgtaaataaagcacagagatcgtactcttcttctccatcacccaatctcatcaactgtacgttcacccttgcttgccgcgttgagcagtagacaacccatctccttgagaatcaccatactcctgtactctgctggattagctgcggtcctgcttactcgtgcacacagagcagaaccctggcctccaaatccctattgtttgcccttgaatgcacacgacctctttaagcgctcctttgttgtagcctctctcctcccttttctcctggacagaaggcttctttgaggacgtagcacacctatctaacgatttgcactccaacttatctgttccattcgcaatccagaattattcaacatgcccaagaacaagggaaaagtaagtgacggtggttgctctatattttatgtcctttgggtttttttggcacaccttaccaggcatactgacgtaagttgtcactgtgcgaattggaactttggttgtatagggaggaaagaacagaagacgtggaaagaacgagaacgagggtgagaagcgcgagttggtcttcaaggaggatggacaaggtaaagttcaccgatctgtcacggagtagttgtcattggaatttctgtccctcggatgccgagcacaaccctaacgagacttcctccctttctttctcgcacatcttttttttatctttgttacctccctccatctgacgactcgcagagtatgcccaggtcttgaagatgctcggaaacggccgtgttgaggcccagtgcttcgacggcgagaagagacttgcacatatccgtggaaagatgagaaaaaaggtacacatccagaagaaactgtttttggtggatttttgttttctttgcccttggcgaaagcaggatgtctgtgcgctcttcagcaaaacaatgaggacatataccacaccatcaaaaatcgatattgcaacgataccacaccgatcacggactcaccttgacccgatcactgcattgccatcggctccgagacgaccccaacaagcacagaaacgcgagcgagagcatttgtcagcatctgtagggaggagaatccacagcgcaagcaaattgtctaacgaacgatggtactttctcgcctgtcttttaaacgacgtgtaggtctggatcaaccagggagatatcatcttgatttcgcttcgtgacttccaggacgacaaggccgatgtcattctcaagtataacactgaggaggctcgtaacttgaaggcctacggtgaattgcccgagagcggtatgaatatttggattatcattgatgctgcttatgaaccaaccatgtcgctgagccattgaagcacgaaactcacactcctactttgtttccgctctttgttcgcttcctaatactttcacagctaaaatcaacgagaccgataccttccagggcagcgaggacgagctcgatgtcgagttcgatattgatgagatttaaagcaactagtcccccctccatccatctctctgttctttcatcgtttttttttcacactttttttttgttcacgcttcattgccgataagcaaaaatatacaatcattttttttcactgttcctctcctgatatgccatgggatccctgcagtgtgcgcgagctattgtcaatgaaagtgctgttttgtcgtgtatttcttttgtggaaggtttgtttcgattctatgcagaaacaccttgcttcttcttgaagacaacactggatatcgtttgacccttcacacctccgaacgtgaacgtggggtacttcagatgcgagtcgtattcaaagacttaacgtggtcgaccatgcagtaacatatggagagaaggagaagcagaacaatgtgagtttgagttttccacagacctatccgagagcaggattgtatacttttgtatctttccttcctttaccttgagagaatcgctgaatcaattcgggctgggtccagttacaggaggtgatgagcaaccgcccgtcgtcgtgcatcatggcagcgacccgcttcggataccgatctgccagctcttccatgttatcatcattctctgccagcacaatgtgatctttgggcttgccctcatccgatcctgcagcaacgtctgtttctgctgctgttgctgttgctgccgcggcggcggctgcatcctgcttcttcttttggtgcagactaatggcatcgtatgtgcccttgtcgagcatgaccataaactttttcggctctccgttgccgccttccgaagcctgctgggtgcaccatgccaaggtttccttctctgccaagaaatccacggcttcgtacttgatgacgtcggccagttccttgtcctcggccacggcacgcgcgagttggatggctgcaggcgagtagtcgataccggtcagatcctcgaagccgagttctgcgagatcgaggaggagatgaccgttgccacagccgagatcgaggatggagcacgtctccttgtggtcttcgtaatgttcctcgacccagtcgaccatcttgaccgcactgtcttctccaaacctttttgttgttgttgttggtggtggtggtggaggtgtagttgcagttatttgtagacagtgattgaagttaggaggaaagatagtattgtctgatcatgggggactggcagatgtgaccatgggctggtgtagacgagcttttttctttccttaccagatttcaccaatgtcgccatgatccttgtagttgataacctcgcgatcatataccttgtcccaactgtgtgccatgaaaaaaggagtgagatacaataacgtcagtctcgcggagttactttttttttttttttttttgcgggactgaatgtggcaatacgaaaagtctgtcgacatgggtaaagtccatactaatccttggttccaagcttggagggtccaaagtcgggctgtgggatgttggactcgtttgacattgtgattccttgttgggcggtgatgaagacgatcagctctacgttgcagaagcagacattttttttttctatactctcccttcttctcacggtggcttgcatcgatttttggcagatcgcatcgcatccattgcgttcaatgttactattgcgcgcacggcgtacccttacagcgaactctagcaggtcccttgcgctcccaatcataccttcatatgcatacagctagaatattctccagcgaccgttatcagcctgcatggtgttagttcatttatctcaacagtatactttttttttctgcccacatcagaacaacgcggtcggggagtgctgagtgctgagagctgagagtagacgctggtctccttgaatgtgcacgccccccacaggcgaccaaatacacatctcttagacggccaagcgaaaagaatgccccatggtaaaacggctgcttgccgcgtttttttcattttttttttgaccttcctgtgcttgattggccgaggacagtgaaacctgtgttcaggaacgatcacaccctgacctttcgacctaaaataaaatgaccttgaaggatctttgctccatccttcttgcaaaaaagcattcctttcaagtccccaagtcgatctgatggccaaaaaagcttccccgagcacgcaaaagtgcttgcaccagggttcgaacctgggaccttgtcttagtgagagacatgtgataaccaactacaccacgcaagctctcatttcggagttgcaaggttttcgcctccagcccttttataccatcttcaaaagtccaacattgaacgcatttttgtcaaaaggccccaaaacgcgatttttccagcttttttttttttttctttttttttccgtttctgggcagagcaaacgcgcccgaggacgcacgagtgttggggaccactctgggagcagtggtgatttctccgatctaaccttgagacagggactagcggctaacgtgacagtgacaaatgtagcagcggacgagcgagtcatgaacaacttttatgggaggaacagtctgaacgttatggaacgccttggtaggctgcagagcttatttttgagtgacgacgccgattagaagaggcctagtgcccaacaggtcacgtagaggacgggtccggccgttcatgcgtctggggttaatggacaaggagggatgctggccggcgcaggcaggcgcggcagtaacgggcgagccgtggcttctcaactaacggcccagtccaacacagtttaaagtcgccccccaatcatgcttccggggatcgtagttaccaaaaaaaaaaaaaaaaaaaaaaaataccgtttctgagcactttttggccacatcttggatgctggcgcccaatgcatgccctctggctcatccgcgttgagtaaaatgatgtgcaaccggtactttgaaggtgcattttgcatgacttagagcaggaatgcgagaatgggagacagagagagagagagcgcgcatggagagaaactggctaggggtagacaaacaagctgccgagcaaccaaatactgtaccgtcctatcgccctcctgtcgcctttcatgcttccggcgaagggtgtaaacgacgttttttctcacaagagctgccgcgatcatttgttcaaacgctccattgtgattcccttacgagttttacagggaatgctgacgagtgatagctaaagaggagacgcggcgagtggccgccaaccatctcgagcttctgagcttctgtctctttattcagaaaaaaaaaaagaaaaagtgaaaaaagaaaaaacaaaggaagtaaaaaaaaaaaagaaagaaaaagaagaaaatcgtgtatagtgttatgagatgacagtggcaggaatggttgcgagagggtatgtcgcctccgacataaaggattcgaactgctgtgtgcggttgacgctgccttccgacgcggcgactatcgagtcaagcacgtaaaagcatcctctgccatcatttactaatgccgaaggtagaaatcatgctggagatactacagctatcgatatctcaagacgggctagaacgtatcttcaccttgataagcggtacgggcgatggtgctcttgcgattggtgtgaaccgatgctcgcctttccgctgtatcctgttggtgctgcgtggcgatcgagtggtagtggtggaagcggtggcggtggtgacagtggtagtagtagtggtgttggaggtggtgttgaagtgagtgtaggaggggattgggaaaacaataggaggtgctaggaaggagtatgattgagatcggaattccggggtgtgcgagcgagcacggcgtggtgatgatcgtttcgataggggaggactaggtggctgttcagaagcacggcgcaaccttaacacgcgattatcgtccgaaggatctggagcaggccgctcctcgactgcgtctctccgaggttcttgttcagtgtctgattcctgggaagaaagtaataatgccgaacgcgcgtcttgtggggaattggaaggaccctgcgtagatttattaatggttccaacagttagcgcaaaacttggctaaagcgaggtatagttgatgtccaaaactgaaatgtaaggtcactcctcgtcaatgtacctttgcaataacctgaactgcttgcgtcgaggacggcgcaggaggtgacggcaaagtatcgggtcggagaatcagcggtacgggcgacggcggcctcgcaactggggaaaaccggtgctctccacggtgcttgattctggaggatctggaggagcgatctgttggatgagagggagtgaccgggaaagggctgggcgatgccgatgccatgaatgaatgcgatcgcgatcgtggttcccgtgaatgtgaacgagcacgaggcggcgactgccgctgacggacagaagaccggaatgtttcctcagatgccctctgcaactctcttgcaaactcatgtgcaatcgagttcttccctttgatcgctctgttatactctgctccatgatcctcctcgtcatcactctcgatttgaacaccattgacaggtgggggtcgttcatcgacaacaacgacgtcctcgagctggcgctgatccttgctttccaaagtcctgactgtgccacgatacattggccgtgtgatcagctcaatgggtccctgggcccatggatgacgaggatccagctggacttccctcacttcactgtcaatccgtatggtgttccggccgtaacgatcccaacggtcatcatcgtcattgtcatcatcgtcgtcgggaatttcgtgcacctcgataggcctccttggacggttctggctacgctcaacggattcagacgacctcgaaacaagtctctgtagcgttggcagctcgaacgacatttggcgatcaaagcctggaactcgtgacaagaaatcgggctgtggataactaccgactctttccgggcgcgtcagatcgatcacttcaatgacctcctcctcctcctctccctctttgtcctcctctgcttcgaggtcgtgaacgcgtggctccttgctgcttgcgtggccacggcgactctgccaatccactgatgagggtggggttgatgatgaggacatggaactattgggcgaagcggaggcagatgcctcgacgctcggtgggagatccacgttgctctgcaaatcggaaatgaaaacgggtacgaaggacggacacggggttggaaattactatctatgtgcataccatcaacaacccagagcgcacagaattgtagcactgcgcgcgcgcgagctgtttatccgcctaccatttcgttcttcagcttccggtcgcttgtttgattactcgaggatagaacagccatggtttctggctttggttcagggagactggcatggccaagaggtggaagaggggtcagtcatgggatgaagttctgcagacgtgggtggcagggcattgagcaataagcgacggggcaatagaagcaaagaaagagctgcagagacgagagggaccacgcattctgttgtcattgtattcaggcattgttttggctgttgccaccgcgcgcatagcaagatgcagagactgctgatactgttagtggtgttagggccactcggcgctaaacaatgattatttctttttgtcaatcgagaaggaccggaaaagggagtgcggctgcagaggagagggggagggccagagcttgagggccagagcttgagagccaagcaatccttgggagcacaaccgatgattgttacaggcgtggtgctgctgacccaaaaaatacttgctaaggtcacccgttgtgggctgggccagataggaagcgatagtggatggagaacaggcaaaccgtctgcctatggcaccccccagcaggatccccggcgccggtgtccctcctcccgcgcccttcctccctcgagcacttcaagaaaacaagggttgcgtgggcagcgagctttcacactcaatgcctacaaacaagtgggagaggaaaataaaaaaaagaaaaaaaaaaaaaggcccgcaagacaataaacgagagcgcaaaaaaaggacccgaagatatcaaaaagggagatggaggctcctgactttttgccctttctattcgacactgactgatgggagggaacgtgtggtgggcagagcagagggaggagggaggagaacggaggaggagggggggggggacgcatatatgccaggagaagggaacagtgggtgcagcgcaacatcatgcgcgtacgcggtgtggagacaacaagcgtcggggtgtgtcagcgcccgagtgtgccgctttgccaccattctaggctgcccgcactgcggcctcgccagcgcgggccatggggtctggcgggggcagcaggcaggacagcgcagcgtggcagaaacagcgcacacggcacaccagagggggcagacgacgagggggccaaaaaagggcgggaaaaaaaaaagcacggcactggaggtgcgtgacatatcgcacgaccagaaaagagacaaaaaaagagagagcgagagtagggagagtagggctctcgctcactccctccctcatgcagtccgtcactggcgcacctgccatgggacccactccgcagggcggggttggccatgagcaagcgatgcaatcagacagcggcgcaagggcaaggcagggatgcacgggtgcgggtgggcacagggtggtgatggagcgtgtgggcagcttacccttgttgaatcctcagttcaagcaggataccgtttgcgtaatgaagagagaagagagaaaagtgtttgaggaatgagcactgtgccgcctgaggggcgctttttatgcagtgggccatggcagagcaggcagcacgcaagtgactgttttggggtcgaatgcgaccgacacttcgcttgctctgctcctgtcgactgccgcttgtgctggctgtgctggtttgttcccaacgttcattctctcactctctctctctctttctctttctttcttcactctgtctcctccaccttgcagggtcgagtgctcagcactcagcactcctcgtgtcccgcaatggctcgagacactcttgaacgggctcactcgtagcacggctcacggggcacattgtcggtggagcgtttttttacaatccacagtcccaaaactgggcgccgatcgcaagtctgtttcctgcacgagatcagcttgatcatccataaacgctccaagtcctgttgccagtgccaggagcaggagcagaaacagcacctgacgcgcctcaccttcaggctacgactcacattcgaccacttcacgacagcactcaaactgacctcccatctctcgctgatgatcgtatatttagcctatggaaaaactcccttcgcacactctgtactgtttctctctgaacacttgcaaaggctccttgtccaccacaccagcctcttcctcctagtcagctgtaataaaaaactcgcttccaacccccaaagaggcaactcttcctggcatcgcctgctccagcgccgcctttgctctccatcccgagcagtgtcctggagccaggtacgaaggcgcaagcactttcatatcctccacagtttctgcaaaaaaaaaaagtacaagatcagacaatgactttgtaagcgttttcctaaccctcccaagaccataaaaaggcagattctttttgcctttgcaatacatgaacacgaacgtaccctggatcctggtttcgactgagtgaccagccaaatggaaccctccgacgacaaagaacagtccatggccatcgttatctccagcgctatcgctcttgaaggcacacttcacgtcctggcacacgttgatcactccagcgtgactacatccggtcagcaccacgatgcccttggacttgactcgtgccaccaggtacctctcgtccatgatctcgggttctgaactccaagatccagtctcatcgctccatcggacatggcttggaatcccagtctcgtacgacgtctttcgagggatcactcctgacacgccaaagaagccgtcgcacactgtgtgcgcatggtcgtgcaaggatatctagggcggacaagttggcagatgcaacatgagtaccaacaagcactcttgaagtccatctgacccattcggctctgtcataactcaagatattgcttccaacccctgtttttacctgtccaccggcctgctgaaggtcctgtggcgaagggtctggaccccagcccacatactcgagaacgtctggtagctgtcccgaagcgtcaggtttgaagagcgcggcgcccctctcatcgggtctgtctggatgcagatccacgaccactgtgatccagagaacaagaacactatgactataagtgacccctggcgtgattcatatgtgaaatttcgcatcgaggggtattgatttaccagacgatgagccctgcgcttggcgcgcttgatgacactgctttacagccgcgatcatgcctccagagtggtcaatgtgccagtgtgacagcacgatcacctcaatcttctcaaactcaacccccagtcgcctcgcgttctcgagaaagatggccgaatggggtcctgtatcgaacaaaacggtgtgctctacgtcgtcttttatgcccgtctaggattaagaaggacaagaataaaactaaacgttgaaaatactaaagaaaagtcatcacataaatggttgttgtttccttaggacagatggttttttttgggatcagcactttaccactaggatagacaaaccatgtgcaccgcagcagaggtcgttgaaatcgaaaccgatggtctttacgcctttgtcctgaacgtcgtgctgaaccggcgcatgcccttgcgaagcgggggtcatttgaactgtggacttgctcctatccaggttacggtcattcttgaaaagcttttgcgcaagagttgtcaggcccagttctttgggtgttgagctcataaaatcgacctcattgtcgaccaccactgtgaggcgcagtgcgtcgagctccacgaggtcaggaaatgaattggcttcaggtttggttgatgtcatgagtggaatcgagaagaaccagtgaacgaatgagtcagaggacgacgcgtagagaagaattgaagtgaggtgaggaatggagtgaaagaactgacacaaagtcacgaacttgacgcgagcagttgtggcgggctgggattcattttcgagagtgcctcacgtaccatcgcatgcactttaagcgggatagacgcgcagcggcccttcggtataccctaaatgattcaaacagtttaggttgttttccaagctgcagaaagcaggacctcgacacaagttgggctaaagtgcttctcaagggtgaaaaaagactaactctcctcgatgatttccagttaccatgggtgcgcgggctctactctgctcgcaaaatgcaagcttgtccttgatcgacaatcgtcaaaaacaagaaacagctccagggaccaaccggcagcaaaaaaaagtcaaaaagtgcttgcaccagggttcgaacctgggaccttgtcttagtgagagacatgtgataaccaactacaccacgcaagctttcatttcggattttcaaaattttctcctccagctcttttataccatccaacactgagcgcatttcttaaaaatactcaaaaccagcgcttttcccggttcctggctcgttttggccctattttcaacgctggcgcccgatgcatcctctggcctatccatgatgattatggtgatgtgcaaccagcactctgaaggttttttttaggctttcaggcgtgagaaaaggaggagaaaacgagagaaagagaaagcgaaagcgagagagagagtgacggggtctgacgttatggacacatagagatgctggtcggcgctggcgaacgctgcagcaacaggagaggtcgtggtgccttgactaacggcctcattcaacatagtttagagtcgtcctctgatcatgcttctggggatcgtattcttctttgaagtcgggctggcggaccctccgatgatctctctaaagcaaggggagcaagggtagcagaggaagaaagggcacagtgtccatgctataatgcacccgtgggtcaaagagatcctgcgaagtttgcggtggtagcgatctccgtgcttttttgaggcgtgttttttcgcgtttttcgcgtttttttttttcttctgtaaactttgcgaatggacagatagtaagagcagcgagtgtgccataaggattgtacttctgaatcatcctcatgctatgcttccggggaccttggtgaatgacaaaatagtagaagcaacggaaaaaaaaagattcactattctgttctactgaggatgatggcagtcgaatgaaaaataggacggaacaacacacgttaacaccattgtgtgcttaatcctgccctcctcaagaagctgtgcttgcttctgaatcattttttttttagcccaggagtggcgtatatagccgacatgagcgtggaaagatgtgaattgggaaggtctttgtttccttgcagtgcgtgcgcgacagatgacaatccacttcacccgacagagtcttcgagtcaaactcgactttcaaggaccaacagaatctgactgaattctcaacccctctcttaaggcaatttcatctgcgagcacagccgattggggagcaagagatctgaaagcgaacttgagcggaagatcaaactgctgtggcggttttgaaggtagggatgccaattctaaggaagccaggtggtcaaaatgatcagcgagagaaagtgaacgatggagggaataggggatgcgcacttgggctgccttgacgaacacaggagaatgcatggcagagggtcgcgttctgccatagaagtcataaaccgtgcgtttccatgcaggtgtgctttccaagcgcggcttcatatggcagggaataacgtcggctacgagagcacagcctgggacgttttagtgtggatctgtgccctaaaatatatgaatagaagaatagtgctctcaccatgtgcaccatacttaccgtactttgttggtcagggctatcaacagagagcacaagagacgcacttccatcatcgcaccaggcccacgccattgctctcttgtttgcagtacacatcactcgaagagatatcctcgagcgtgtactatacatacctgttttgctatgtttggatgaagcctgtgtgaaagccgtccactgtgcgatctggatggatcgcaagtcctctcttattgcaattctgctgtcgcccctcatatccttagcacaaaaaaaaaaaaaaaagcaagtgctctccaaatgtttgtcgcatcccaccatggaccattcctccagcgtctatgtatgtgtatgtattgtgccctgcgtcgtcccttaaccgtttcatgagagcttcattccccttcgtataccaccattacggatgatagtactgatgagtccatgtgcagtatattacagccgcctacttgtgaaagtgtgcgtgtcccacgtcaagggcgcccaggaggaggcagccgcagccatggtttgcaaacggcgctttccagcgcacatcgaaacagatgaaatagtttcggcaaactgacgctgccgctcaatccctgaacaacctcaagatcggggacactctataatttctaagctttaagactcgtctcgtgtttgagccgcaccaacaacgacgatgacaagttgcaagacagtacaagggatccctgtggcaaatgagaccatgcaggcgctccgtactgtcttgcgggtccagtccgtattcatgtcccaggaccacacgctcctttttttagattatttgagcactaccataccaccacggtccgttgcttcccccatccccccacgaggcacaccatgttttcgtcagcgtccagggccgccgtaccatcctcacaatataggctaactgctcatcgcgtccaagacatctttgccgaaaaaaaactctcatcgactatcgtaaggatcgcattgggacgcactcatatcacggtctttggttggtaggtgaggcagtgtctgaccatgcaaagcttagagtcgacaacttatatttcattctggctttgtctatgttctattctttcccccctcatcaaaaggtcaatttgagaggcatggctcgtgaaacagcgacaaaacaacaatgcagaaccccatgaggccaaggaactgtcaggcattgaatcgattagatttggtcgccgttctgttgtttttttttattgcacaacatttgtctaattcgatatgaccctggcggctgaccgttgaagcagaagcatcgcggagaagttttttttgcggtcaggtcatacggaccattgcgcgctggcatcgccttttggactgagcaaccccaacacaaaggggtgcaaaccgagggctaagacgaacacggagagatactcagggaatctatgcgctgagaatgaaaacgacgagctctgaggggtaaaaaggattcgaataaaggatcatgccgatcaataatcgaacacaactcgccagcgcgaacagcctcccttccccccttcctcgcaacagggcgtgcaacaggtggtcgtcttctgcacacttctgtaaagaaacctgtctgagtttatgacttttcacatcgctcggtagcctacagagtttagtattgtctgggcaagatgctgtccgcttgatcaggacagtagatgagaaaccactcttttttttttttttttttttttttgcattatcggcatggcgagaaagaagatcatgcccgtgcattgactaagcgttatgccttgcacggcagtgacaatgacatcgccctccccctcgcttgggctgcccagttttcaaacagacacagggccaaggaagaccaggaagagtgagctgtcgatgatgacggacggacatcgctctccccttccacgcacctcctctgctcttccgtcccacgaggtttttttgtttgggtgccgaaatccaatgagcacaaagagggcgagtggggcctaaagaacgggagatcgcagccgcgatgaccactacaaactctgataatacaaggtcaactgcagattcagagagaagagtgcacattcttagtgcaggatgtggaaggagaggagcaggacaacgcctcttttcatacagagacggcatgcattagcagcagcagaagctacagcatatcagcaacagcttcagcagcagcagcagcggcagcagcggctacagctacgcggatggagaggcaaagcgcccctgccaaaggaggcggtctacagaaggagcatggggcgtgtgcagccagaagcccagaaatcggaggaatggacctggactgaatggcccacaggtattgacaggtattgactgtgcaggcatgcacggccagagtattgtaaagtattgtaaagccaattcaaacaaggccctgtcgtctgtagtgccttgtgccattcgaccttttcgccacagaacagagactcgagccacacacaacccttttcctctgaccctcattgctctcgctgctctgcacctctttcctccgcttcttcgccttgtcgtcttgttcccattgctgcacccccattcaacctctccacatccttgttctcctctgctcaacaacactcgcattcgccccgccagacccaatagattcgcttttttcttcttattaccttgctgcattgcacacctcgtttttttttctttttttcttttttttcgtctggttttagaacccgcttcttcagacactcatggacaccaccctgccacggctccgttcgaccacaaccattcctccgtctgtgtccttctccgcctaactgccacagctcttgctgcaccctgtgccctcgtcaagccgtaaccaccccgctgccacaccgtataaaagaacgaaaaccgagaacactctaaaagagactgtccgaagaattattggtcacaggagacgaccctcggaaagctcgaccaccccccgccttcctttgatcaggccagagcgaaacgataaaggaaccaaaaggtacgttctttgctcgatatctccctgtctgtgcaggtggtttctgtcctcagtcgacgatgtgttggtctgtctgctgctccctccgtccctctatctcctcctgtcgttcaatggcccttgtgttcagaacctcaaatcacggtcagaccaggtcagaccagggttagacctggtcagccagataagcaggcggccagccttgcagccaaaccgacagatgtcggaaaacagctaggctgcccttcgtgcctcttgtgaatgaagggccagagtacatggactgcacatacgcctctttctcctttttttcaggtccatatttttgttcttctacttggccggtttcttctcatcgcctgctgctcagagccctcttcactctctaatttaattttatcaatgtgttttcggtgcttttgtatgaagctgtttgtgggagaggacgtgtgtattgctcgtccgccatctgtgaatacctgcgggagagaatacgtctgttcttgtatatgtgtgccccaagtgaagcgacatgcgatgtttgatgtttgatgcacgctgtgccttgtgcgtggtgctgactcctacgggcgtgagttgcaagagtggtggtgatgcgcgctgtcagccatgcagaacctcaatgcaaacgcataacgacacgcaagagccaggagccatccagaccccagtctctgtttctgtttctcgctctcgtccgcccttttcttgatccgtcctggccactgccaccttatacgcaaaccataccaggaaccgcaagcggacctgatacctccatcgctcttgttccccttcggcttctttttttatctcactggggcgagctattcgctccgttcgactccctggacccggatcgtcgtcgtgttccgtggattaagagttatgtgagcaaaggtgtgtgtggtttcgcacttttcggtctccaatcatcctagaatattgtatgcgtcccatcatatgctcccttgctttgcttttgaccctagtgcttatatatatcctcccccctcgttccctttctgcctgccatcgtttgcaactttttgctcgttgacttcagcctctgtttgtttgttgtgctgccaacctgatatattgtgttgcctccggttcgtcataccgcacatcctctctctctctctctatttttttttttttgcatcagagctgagttatttcttcgcgcaccgcagttcaccttgtgttcgttccccttgctgtttgtcagctcgcacttctgtggtcgtccgcaattataataggagccggtaggatactcatcgcgcaatcacaacccatcaaaccgcatatcgctctggtgggggcttaactttccatcccacagccatactcgactgcacccagtctcgttctgtatcagtagcacttcgggttattactgccttctactgtcctggcactctctttgctcgtttctcctcccccttccttgacgtttagtccttcatatccccttctttcttctgtagcagatcacaacgccccgttcctcatcttggtcctgcagcactgtcacagccaaaaaaaaaatctgatccttccctctttttcccttccttctgtgttaaaacatcatttctaacccaacgcctcttcttgcctccttttcgactcctgctgcctcctttcctcagcagattgtccgccatgtccgtctatatgcctcgcaatgttattgtcatccccagagacgtgtaccaaaagtgcaccgacgattttatcactccacgacagaagcgcatcagaggcaccgcccgaaagcagcgctggaatgccgcggccgcacccccgcactgcgagccgtcttccaagctcgaccaaggacgtccgaataagaacgatctcttggctgccatgccatcagttgcctccatgctctacacctccgcatcctcaccatccctcacctcctccctgtcctccctctcctcgtcatggtcgtcctcttcctcagaatctcctggctcccacaggctggcctcttttggcaacatcggtcccaagaacgacgtcaacaacgcagtaacgattgcaaacaacatcaccactatccatctgagagccctggtcgcaccccagaagcgtaagctctcgcaacaacgctctagcagtgctctcgctacctccactgctccagttatcgacctcacagacgacgatgaccaccagaaggcttgcaaaaaactcaagtatgatacaccgccggtctcgcccatctcacccccatgcacaagtataacccgcgttgccatgccggtcaaggcgcgcgaggttattgaaatctcgtctgacagcgagatggaggatgttgtcatggatgctggctgtgcgccctttgccgctgcatccacagccactggcgctgctgaaagtctccacaagtatgagctcgagccctcgctacgacgcatcgtcgacaccatctttccagattacgaggctcatcatcaagcgacgctcgagcgagctttcgccacgagccgcagccttcgcgagaagtatgtcgtaacgcgctacctcggtagtggcgccagcggctttgttctcgcggctaagcgtgtgtctgacggcctggaggtacgtatacagagaggagatactctcttgccctcgccgagcgactgctgcccatagagtgtgaacatagagtgtgaacagcgactaattgtttccttctctctctttcctttttttttttttgccttgtttcatcaggtcgctattaaggtggtcccgcacactggggaccacgtcgaggcccgcgttcaacgagagctaaacattatgctgaagttgaaggaccatgacaacctcctcgggtgtgtggagtattttacgtcgtccctctatggcgacgttgaccccgacgacgagtccaacaaggacatctcgtacattgtcaccgagtcggctgcgtgctcgctttttgactttatcgagctgcaccggccagcccacgatgaggatgcttcgacccggttcaagaacatcaaggactttcttcagacgatccagcatgtccctggatcacaaggtcgcagtcctggttccatatacgaatcgggcatgaatgaaaaaacgctttgctcgattttcacgcagctggccaaggccctgcacagcatgcacaaccaatgcattgtccatggcgatatcaaggacgagaatgcgctcattcttttcgacaagacccacaagacctaccgggcccttttgtgtgattttggtcattccaagtacttggcccctggcagcgcccccagcttcccgttttatggtacgaccgtgttggcccctccagagatggggcctaatatggagatccgccagcagatgcgcaagaaacaaaccagtgccgcagccacgacggcgagtccactcacgaccacgacggtgacgactgctgcgacacgacggcagacccgcggccgggccgcagcagcccatgctcagggccagccaccactccagcacttttatggctacgaggccgatgtctgggccttgggtctgacgctatacaccatgattcatggagatttgcccaaggaaatgtttgagaaggacaagaagcacatgaagtatatacccaagcgcgcaccgcgaggcaaggctgcgaacaagtttcattttgcgatgcagaacaaccttgactctgacctgagggaccttgtccagggcatgctggccgtcgaccctgcgaaacgtctttcgatgaatgaggtcatgacccacccgtggatcctgcgcggccagcagtagatgctcgaccgggaccctttttttttttcttcactttcactctctcgctctccctcctctctctcccccatcctcacgatcccgctgtataccaaagcgacggaaacaaacaataattccttccatttttttttgtcttgctattgtaacccgctcttttgaatgcccccacaccccccagtgccgcatgtactccttcccttgctcctcagcctctagctctgtctctctctgtctcttctcgctctgtctctctctctctccctctctcttctcgctctctctctctctctccctctctcttctcgctctctctctctctctagctccctcttaagctctccctctctctcaccgttttagacctcttcctcttacctctctgtctgccccgatcccctgtcgagctatatacttgtaaactagcatcttccttcctttacatccaaatgaaaatacaacgaactatctgagtaaaaaatgtttatacataagaaacatggtggtctgcgagggtaatctgaagggctgttagataaaaaaaaaattgaccacattccagcgtagaggcgacggaggccggcggtgtagaaccttcccctccccccccaccccccccttttcctctctaatctctagctctctccccctcttcttcgttctttatagcttggccatagttcgagcgcggctttgagcctccaccaactcgtccaggtgtgtctcaatctctgcgacgacctggttggcacagccaatgctggcttggtatccaaaacctgcatggccgtagttatgggcgaccaacgcgatctgatttgtccagccttcgttccagtccagttgctggacggaggctgaaacacgcacaccgccgcgacggttggggcgcagacccacacagcttcgcaggatggtggccttggagaagaggtcgggtcgtgtggccaggacgcgttgcatgatcgcctgtgtggtctcctcgcaggcggcttcttggctgtttcaattgagagggaaaacgaaaaaaaaaaaaaaagtgcagatcaagacatgggtgagcgaaaaaagggagaactggatgaatagcagaacaagggaacgcgagtcaggggcttactagttccaatgctgcatggtaccgccgaggacgatctcgccatcgtctcttgggatcacataggtgatggtgtctgaccccgtggcacggtcgtgcccgtagcggaccaaggtgagctgcttgacctgggcccagatcggatcggggactttgacgacgacggtctggcctcgtgtcgggtacatttgtgcatcgtgcacgcctgcgaggtggcggcttccgaggcccgagcagttgacgaggatatcgggcttgagatggtctcgggtggggatttgagcgagggctttcagactggggaccgtggcgcgctcgaggagaccgcctcgggcgagaaactgtttctgaaggtacatgaggtactttggcgtattgattgtcactaaaaaagattttcagtattagatgatttttttttttttttttttttttttggaggtatgtattgggagcgaaaggggcctcccgtcagttggcgaatacgttttaccagtgctgtaagcgattccaaacgcggtgccggaaggcagttcgttcttggggatatatcggtactatgatggatggcgacagcaggggcatgagaggtcattcaggtaagagagatggagaaaagccacggtagagtaccggtatcaaaaatgaaaccatgagccgttcatttgtttcgtttttttacgtttttcatgagacgcttgaaccagggatcctcaaagtccttgggctcggtttcccagtactcgtatgctgtaacgtccatgatgccggcttcgggttcattctctgccaggtaggcgaacctcttaaaagtaactgtgtcgaggtctttttgtgatgccggtggacgaacacttgcagattagtgaccgttcattgagcacagtcgaagattttatgcaaaagtgtttctcaccttgctgggcgacatcggcgttgtcagcgaacgatcgccagttcgctccagccctattggaagcaaagtaagcggggcgtgagttgtgcgtactgacggtcaagtagatgggagagcagtttaggagcacaaacggtgctcagcgcatgtatggttggcgcataccaaggggaggtgtagtcgatactgaggtccgagggaagatgtgtggcgatgactttaacgacataatgtcccttttcctggagggctagggccgttgacaggcctgagacacctgcgcctaggacgttgacgttgaatggtgagccgtgcgagcgggtcatggagaacgaggggtgaatggaatggagaaggacaggggagtaaagacgcagccactgtgggaaaaatgcaagagttggcctgactgcactgccccaaccgccctgtgcaactttgatgcggcggtccgaatccttggttggaccgccgcctcttattcatgctagagtgggacaaatgcacaaggagaatgaactcaaagtgcatgttgtatttcttgaatgtcccatcgatgtacgtccatttttacaggagaatccttgctttagatttttcatgtatacggttggtatttgcaatggattatgtaaatgattgacaacattccaagctatttcagggggtagaatgtggccctttctctatttctcatagcttggctatggttctagcgcggcttcgggcctccaccaactcgtccaggtgtttctcgatatctgccacgaccttgttggcacatccaatgcttgcttggtatccaaagcctgcgtgaccatagttatgggcgaccaacgcgatctgattcgtccagccctcgttccagtccagctgctcgacggaggttgaaacacgaacaccaccgcgacggttagggcgcagacccacacagcttcgaagaatggtggccttggagaagaggtcgggtcttgtggcaagaacgcgcttcataatcgcctgtgttgtctcctcgcaaacggcctcttggctggtaaaaaggaaaaaaagggcagatcaagacctcggtgagcaaaaacagaaaactggataaacagcagaattttgcggaacaggacgcgaccaaggcttactagttccaatgctgcatggtgccgccgatgacaatctcgccattgtctctggggatcacataagtgatggtgcccgtacccatggcgcttccctccgcgtagcgctccatggtaaactgctttgcctttggccaaatctcatctggaactttgacgacgacgatctggcctcgtgtcgggaacatttgcatgtcgtgcacgcctgcgaggttgcggcttcccaggcccgagcaattgacgaggatatcgggcttgaggttgtctcgggtggggatctgggcaagggcttttagactagggaccgtggcgcgctcgaggagaccgcctcgggcgagaaactgttcctgaaggtacatgaggtactttggagcattcatcaccactggaaatgataagggcaagagtaagggtgatgcagagcgagaaacggtaggtgcaggtcagcatggatagcatgagttcatgagtcatgaggaggtgtagaacctactatcacggatctgggtcgatacataccagtagtatatgcaattccaaactcaacgccggcgggcagttcctccttggggatgtatctgtactataggatgcgaggaggcattggaggtacgatgcaaggcgtgaaacagaaagccgttcgtgttaaggccgtggcaagcatgtccggatcagtggtgtcgtttagcgctcatgtcatccattttacgtttttgacaagacgcttgaaccagggatcctcaaagttcttgggcttgacctcccaataatcgtgtccggtaatgtacatgatgccagcgttgggttcgttgtctgccaggtacgcgaacctcttgaaggtcaccgtgtcgaggtctttgtgaggccattgagaagtggaggagtgttttgcaggtcagaagtcgagaggttatcaattgccttttgtagggcaaaaactctttacgattttaaacttgttgcagccttcgcaccttgttgaacgagatcagcgatgtcagcgtacgatcgccagtgcgctccggccctattcagaaaaggcaggggatgtgtgaggtccgtgtgccaacggtgaagtggatgcgagtgcagtgtggagcaggatcggcgtctgaggcatgcgtggtcgatccataccagggggaggtgtagtcgatatggaggtccgaggggaggtgtgtggcgatgactttgacgacgtagtgtcccttttccagcagtgccagggccgttgacaggcccgagacacctgcgccaaggacgttgacgttgaacggtttgttgtgcgagcgggtcatgagggaaggtggggggtgatggagaaaggagagcgacggaggaatgggccacggtgggaaaaacggttctcgaggtggagcaggttcgccgaatagccgtggccagtggagtgcatgtcatgtgacacccgcgcctttttttgggtcttttgttcttgtgtggccgttgtccgcatgggtgtgtctgcgagttgtgctcgctcaaaatgcttccgcacctgctgctctcactctgcttgctatttcatacagcgctctcttgctgctggtcgcccctccttcgctccgtccctcgctcgtcgctcgtctctttcgcctctcttctcgcttcctctggcgacagacacacccaccccatcgctctttcattcactccctcactctccattctctcgtcctcgtgcatctcgttatcgccgtctccttttcaaaaagaaaaaaaaaaaggacttggtattatttccttcacacctctctcgctcttcctcaccctgcttccccgtctcacccattccacacccactccaacatggccagcgcaaccccgaaatatgctgccaagagcactctgcgctccatgtaagttggctgcaaatagaagcaaaggaacgaaacaccgcacatccacgccattcacacgcatccgcgcccacttgtttctcaccacccgcacggtgatggtcacgtagcaaaaacttctccaagggctacaccgacatgcaggccaaggtccgagaggcaacctccaacgacccttggggacccagcggcacccagatgaacgagctcgcaagggcaacctttggacagtaagtgatgaccacgatcgggtcaatgggtcgacgcgggcgtcaagcttgactgagagctcagagcgtacagccgacattctagagaaaaaagaaaaaagaaaatacacattagcaaagaacgcagagctcagggagctgtggtttgtccatggacccccattttctgaccatcattctctctgtgtgtcctgttgctcgcgtgtctgtagacaagagtttctcgagattatggagattctcgacaagcgcatgaacgacaagggcaagaactggcgacatgtcttcaaggtaagacagcactcagtcttccttttttttgcgctgttgctgtatttgcgtcatcacccaatcgctgactcgggaacctggaggaggccactggaagcactggacttgacaagggtcgactctgcgcctacaggacacaaacaacaaagagccagcgagagagcactgagggcgaggacagcacatgtgggtgacaggcgtgggattgtgtaagagagacagagagcgctgtcaagggtggagaggccatcgcttcaatcgagatcaaaatagagcgcacggttattgagcaccaaacgacccacgcccaggagtgtcctgtctataaatgctgttggcgctcacagggaaacgggacaaaaagagttgttcttctgtcaagtcgcaaagagagagagagaggaacagagagcgaggaacagagagagagggctctcagggagcagttgcacgttttcatgacgtgatggacagcagtactcattttctttttcttgcgctcttgtcgctaggccttgactgttctcgattatctgcttcatgttggtatgtatcgagaggacacatggcacgaattgcttgaattgcttgagcaaatcagtatcctcttcatccccatactaacctggatccacactggtgatgtttttataggatcggagaacgtggtcaagtatgctcgcgaaaatctgtatatcgtcaagacactgaaggagttccagtacattgacgaggagggcaaggatcagggatcaaatggtgagttcagaatgtggatcgttacacgaagcgatggacgagtaatggtcaagtgaactgatttgcgagacgtctaccaaatgcaccactagttcgtcaaaaggccaaggatattacggcactcctctcggacgaggctcgtctgaaagaagaacgccgatcccgcaatgctatgcgcgatcgtatgagcggtcgcacgccaggcgaggaccggtatggggagcacacgcccgtctatgagcggcctggagcaggggacgacgaccgtgacctgcagagggctctggaggaaagtaggcgaatggcccagagtgagaatactcgccataggtaaaaaagctgtttctttgcgcaatttacccggagagtcgcacagccctggggtgtgatcgcgaaagccgtttcaactaacagcctttatcaataacaatgtgatttgtctgtcgttagtgaggaggatgatcttcaaaaggctttggaactcagcaaaaaggaggaacaggatcgcttgaagactgtcgaaaaatacaacgagctctccctgaccgaagattgggaggcagactccaagtaagtgttgcgcagacctcgccacgaacgcatctctctacggtgatgtacatcagcaactaataagaatgattttgacaacgactttctaggcccgtcaaccagtatgagcagcagaataacaccgattttttcgggaacgactttggtggccagaacaacggcaacaacaactttgatgcgttctcgtcgatgaacgacatgggcaacaacaacgacaatgcattcctgcaacagcaacaaactggatttaataacccatatctccagttccagcagcagcagcttcagcagcaacagcttcaacagcagcaattgatgcagcagcagatgatgcagcaacaactccagcagcagcagcaaatggcgtacttgaacacaatgaataatccataccaacagcaactgatgccacagatgactggcgcgcccaacattggatccaacaacccattcagtgctttcgcccaaaagccagccatgaccggtcagcctatgaactcgaacaatctcaacagcggcctcaacagcctcaacagcggcctcaacaacggcctcaacaacggccttaacaatggccttaacagcagtggatttaacagtggccttggaaacaacaatcctagcaacaacaacaatagcaacaacaataacccactgggcgagctcgccttccttcaaagctccatgactggcatgccggccacgagtcaacctgtaagaatttgaatatttcaactcgtcagcaatcataccactgcacaggtactaaactaatacgtatgtggatgtccgtgcttgtcatcttaggctgtgacgaaggctcctaatgctgccgatgaaaagtatgctcacttggcgatggctctgtcgaaccgcgaagatggcatggatacctttggaaacacgggacagctccgcgtaccggcgtaagtacatctctgctagagaggttttagtttgacagtacgatagaacgatccgttaactccctcattttttgcactgactgaaaaaaaatagtcatcatagctttgggcttaaccggggcccaagcaacggcgcagcaaatcctttccaggccatgggcggcggtgccaacaacaacaacaacaattctctgattgacattggtgactccaacagcggtcttaatcgaagcaacagcaacaacccgttccaagcgacgtcacaagcaggaggattcaactcaccaagccagagcaacagtggcttcctttcatcgcacacgactggattcggggcaatgaacggtggatctttcaaccagttctcaacagggcaggccaacaacaccaacggcggtgcgtactcgaacaatacgctgttctgatctgacacgttaggatgaaaaaaaaaaaaggaaaaaagaaaaaaaaagtaaaactacggaaagagggacggagaggaggtattttgtggtatgttgagcacgcactgacgggaccctgcgctgtgcactgtaatgataatgatatgattacgaataaaaaaaattttgcaactggagacccttttttttgttccccctcccatccacccatctacgtccaactggcacggcggagtgaattagagtccgtgcgcacaaccgaccggcgatgcgtttgttgtgtggcttggccaaatcacacccaggccttttttttttttttttttttctttcccttggttcccttttgctcattccttatttctcccttcagcacacgagcccctctccaatgagcaaccgaattctgcagggtgcgaccactggaggcagcagcagcagcgacgccgctgcctcggctgcattcaacgcacggcgacagtcgactatctcacaggcgtacacccagtctgagtactcagagtccgagtttggggagcaaggtacatatcaacacacacccaacacaccagcacaccaacacatacacccacatcttttgttgggtcttggtcgatcacggtgttttccttcttctaatgtctcgcacactctattttttttcatttctcttatagacaatggctgggatgactgggaggacgaggaaggcatggccgcttgcgacccccagtgtcttttctgtgctcagacctttgcctcggcgcgcgaggtctttgatcactgcacccacacccacggctttgactttctccgtgcgcggcaacagtttgacttggacttttatcagtcgatccgcctgatcaactatctccgtcaccaggccaaggaggtcgagcactttggagagaccacttgctgggagggtctgaaggatggcaaggagccctttttggcggatgacgagtacctccggccggtgctggaggatgattcgttgctgtttgcgtttgaggatttggacctggaggaaggaagcgcggatgaggcagcggcggcgatgcggatgatgatgcctcagggagaggatcagaagaggatgacgaggtcgtcgtgggcggatattgtgccgacgacggagttggagcgtttgctgttgaagcaggtgcagcaggccgaggaccagttgtttgcgatggaggttcagaagcataatttggatcagcagttccaggagtacagggcccgcgtcaaagagtcgttctttgatactttggaggatgcgacggccaggagtgtgatctcgcaatcgggacggtctcaggctggaggggacgagacgaaggagcccgagacggtggtggtgcctcaggatgagggcaactattactttaattcgtatgcgcactcggatattcatcagcagatgttgaatgtaaggaaaaatgagaggagccccttgacgaatgtcgggaaacggagagggtgcttgctggtgactttcttgtttttttttttgcacgaggactgatctaatgaatggcctgctttttttttgttctttcttcttttaggatcgcgtcagaactgaggggtacagggattacatctacgagaacaaggacattttcaagggcaagaccgtgctcgatgtcggatgcggtaccggtatcctgtcgatgtttgctgccaaggccggcgccgcccgagtgctctcggtcgacaactcggacattattgagaaggcgaggaagaacattgtcgagaacgggttccaggatgtgattacgttgtacaggggcaagattgaggagatcaagttgccgtgcaaggtcgacattatcatttcggaatggatgggatactttttgctttacgaggccatgttggactctgtcctcgtggccagggatcgcttcctggtgcctggtggtatcttggcgccctcgcagactcggatcctgttgacgacgacctcggacgagtcgttcctggaggacagcattcattactggaacgacgtgtatgggttcaagatgtcgaccatgaaggagaatgtccttcgtgaggccgtggtggactttgtgtcgcccgagacgattgtgaccaacacggtgacgatcaaggatctgcctcaccagaccatcaccgtggcgggactggactttgtctctgagttcgatctggagatgcagcgcgatgaccaagtgagcgcgtttgtcggctattttgatacctggttcacacgagatggcaaggacgtgcccctggaggttgggatctcgaaggaggagctgaaggagcaccgcatgaacggcttcacgaccggacctgtgtacacgaggtcggaagagacgcattggaagcaaaccatgtttgtgctcgagaaggcgattgtgctcaagaagggcgatcgtctccagggaacgttctactgccacaaaaaccatatgaatcctagagcgttggacctgagaatcgtctatgaggtcgtgagggtggagaagactgaggaggagcgggcagaggacaaggcagacttgacgttcttccttcgatagtggatcgtggatgcgattatgtttattcttgagaaaaaaaaatgtggtgcgttgatgagagaatgaaaatgaaatagagtaaatatatataaaaaaaaaatgttctttacatgacacacatacgagtgccagaagatatgagggaatgcaaaaacaaaaaaaaagagagaaaaaagaaaagcaaaaaggtagaatacacaaaggaatttttttttgtcgactgggacgctccttcccgctttgctgtctcgttttaaaaaagtccagctcccgagcgctgcttaatgttcttctttcccttcttgtgcttcttgttgccgagtgcgcctgcaacaccaccctcaacgcccatcccctgcaagttctcctggacactcagcatcctcatctttcggctcacatagccacccacgttgtcggtgcgctgctggtgagggtacatctgcacacgctgcatgccctccgagacatcaagcgcagtctttcctgtcaccttgggcagataggtcgtcttgcgcgagggctggaagaaggacgaatcgaccgcagccgtctttcctgtaccggtacctccgtgcgacagtggtgtaacggcgttcatgttgatgtaggtcgatgccgactgggggagtcgtcgtgtaggcgcctgcttgcgcttcttgaagcgatccagctggttgtgctccttgttaaagtccatagcatcctcacccggtgggggtgcgcagtaaagcagctttccgttgacatagtccttgagaatataacgggcagcacgcgactcatcggggttaccctgaccggccttggtgtaaccacgagctacagcataggcaatcaagaactcttctgcggtgggcacacctgaaccgccctcctcctcgctcaggacggcgatcttgataccgtagatggcttccaggacctccttgggcactctctgtccgatcaatccgaccgagcccgtgaactcgcgaagctgatcaatgggcaacactccgttgcagaccatgtctccctgagtggtggcgaaggaagggaagaccaaaccgggacaatcacacaggatcattttaggggtcaagtggatggtctggaaatgcttggtctttccaggcgtggccgagaccgagaccgcatgttcacccaaaagggcgttgatagtggaggactttccgacgttggggtatccgacaagaccgatcgacatgatgccgttcaaagggtctcttgggtctaaaaaaaaaaaaaagacgggagcaagaaggtaaagagaaacgcgttagattataagtggtgttgcaaatttttcgagcggggtcagccttgcagaaataaggcacgaagacataccattgataatgggagtctccttcatcatgagctcatagagctccttggtgtcacggatgcgagtgcgctcatcgtccttctctgtctccttaacagccttccagtgcgaatgggtcttgttggcctttacgctttcctcatcatcctcctccgactcttcctcggactcttcctcctcatcctcctcctcgtccgattcatgtgcttccggtgtctctgcggtgctttccttggttgcagaggtagtggcattgggcgtctgctccttctgcacctcctcctcttcctcttcctcttcctcttcctcctcctcttcctcctcttcctcctcttcagtgtagtcagagttggcagccttcatctctgccagttcctgggcgatggcctccaatctctccctctcagcctgctccttctcctgtctctccttggccaaggcagcagaaaagaaagtgtaccgaatgccctccgagtcaaagtagtcagcccatctctttctctgcttgacggttaaataatcggccttgttgatcaaaagcagattggcctttctggggtccacctccttcacatatgcctctagatcggtcgaccggaaaaacaaggggtttctggcatcgacaatctggacgatcaaatgggagcgctcaatgacacgccagagttgtctccacacctcaatgttgcgctcaaagggcgtcaacagcaaggcctcgcgttcagccagtgtggccagaccgcgacgccagtccaaaaacgaggttcgctccatgcgctgcagttcgggtccagtggtggtctcgtcccagtgaggacgacgagggaccgtcagctgtgatttgaattccttgtgcttctcaagagtctccttctccttgtcagcgctgagcatgaaggggttctggtattggtttgagatgaccttgatgttgagtttctctgtaagggtttggtgaagggatccagagcggtgttttgttgatgaagcaaagaggtacgaacagacaggtcagcatatcaaacacatgggatatcacgacagtggatggattcttgtgctcacgaaataggatcagagtgcgagagcctggtcagtgctacttgcctgctgtgaactccgtgccggccaactcggcggtgctcaggaacgactccagatcgccctcctgtgtaatggactggagacgagtccagctggcgccatcatccacctcggcagagtgctatggtttcaaaaggggggtttttttttcaggttgttgtttcccacggagaaagcgtaacggtagaagcagtgtgttagggacgagtctctgattatctgtcgcccacgtcaagtcgaggcgtgcgcattatcgctgactacaacgccagccaactttggtcgggaaaaggtgttgaacatacgagtcgctcgtcgccatctcttggacggctgcgccccttgaagcgggccttgatgatggcctgaccgagtccgacgttctttttgcttttaggaatggccatgggttgtcaatgtggagaaaagtgggggactgagtgactaggaagagaggtagggggaggtgggggtgcaagagtatacgacggggggtgacgaagcaaacgaaggcgcggaggggtggttggtcaatgcttgttaatcaacctcgcaaaaagccagctttccaaaaaaaagaaaaaaaagaaaaaaaaaagaaaacacgtcgactgctttttttccatgacatccacgtgatatactctaaattaaaaaaacgcgttttgcacaagaaaaacaaaaacactcaaaaaacgggactcgccagggcgagcttgctagccgctcaccaaaagcaacctcggcggaaaaggatttctgttgttttttgttctctctgcctgcactcctcatccagcaaccgctccttcgcctggcatcgctcgttctcccttgacccccctcgcacctcccttcgccccttttaccgacaaacacagcatggctaacgtaggctgggacgcaggacgcatccacactgcacaggtgttgccgcctcagcaggatgaccacgcgcaggcgtccatggacaaggtccaggagatgttctttgcattcatccagcagttccacctcaatggcgtctacatctaccggtagggctcacaggccttggcacccccctcactctttcttctcgcgcagtctcaaagtgcgttcagtcttttgctcactcttttgctcactcttttcgtgtttgcctgtccatagtgatcaattgcgacagaacaccatgctgaggcgccacttgttggaggtcgatatcggccatttgatctcgtttgaccaggagctggcccacaacgtcacacaaaggccgagcgagttgctccccttggtgagtagtcgaccgcgtgtgatccgacaggcaggacagtcgtttagaggaaacgaccctgatggaaactaacatgcctcctctcgacgcacaatagtttgagaaggctgtccagcagcatgccaagaggattctgtacgccaacgcaaatgtagaggtggagcttgaggactatcaggttgcgttgcactcgagtgccaatatgatcaagattcgccatctcaacgtaagtttgaaaaccaggaccagttggacagagtgcttacggacccctatgccactttcatttcgccaatatcagaaactaagcggaagcgggacctttattcactaatcgcccgcactgaaaaaaacaggccaacagcatttccaagctcgtccgaatttcaggtatcattattgctgcctcgccattgacgtccaaggccaccatgcttcagatcagatgcaagacttgcgcaaagacaaagaagctgccgatccaggcaggattctctggagtgagcatgcctcgtacatgcgatctgtaagttcactgcctgttgaattcaaactcgtgatactttctgcgtgatctagaagctaacagacatgctcgttggcatgtactaggaatgtggacgttgaggcgaaccctgcaggatgcggcatggacccatacgttgtcgaccacgataagtcaaagtgcgtggaccagcagatcttgaagcttcaggagtctcccgatgatgttcccgtcggagagctgcctcgtcacgttctgttgagctccgacagagagctgacgaaccgagttgttccaggatccagagccaccatcatgggaatttactcggtcttccagaccaagcctggcgtatgtgtccttgcttagctaagagtggttttttttgaagctggctgctatcgggagaaaattcagcgagactaacgaggttgtttcttcaaaacattttcagaaaggaaacagtgctatcgccatcaggacgccctacattcgcgttgttggaatcagcacagacacggattctacaggccgcagacgaaactttacagatgaggaagaggaagagttcattgctatgtcaagggagcctggtctgtaccaaaagtttgccaacagcattgcaccttctatctttggaaaccatggtgagttcacaaggatcaactcatgctatgctcttggacacagttgcgacaattcgcagaagaaggcgtgtattttctaatgcgcgtgttttacgtggacttgacttctagatatcaagaaggccatctcatgcctgctgttcggaggatcaaaaaacgtgctgcccgatggaatgaagcttcgcggagatatcaacgtactcttgctcggagatcccggtacagcaaagtcccagcttttgaagtttgtggagaaggtcgcgcccatttcagtctacacctctggaaagggaagttccgcagccggtttgacagcatcggtggtccgtgagccgtcgacacgcgagttttacttggaaggaggagccatggtccttgcggatggaggagtggtctgcattgatgagtttgataagatgagggacgaagatagagtggccattcacgaggccatggaacagcagaccatttcgattgccaaggctggaattacgaccattctcaactcaaggacgtcggtccttgctgctgccaatcccgtctttggacggtatgatgatatgcgctccgccggcgagaacatcgatttccagacgactattttgtccagattcgatatgatctttattctcaaggatgagcacaacgagggacgcgatatgaccattgctcgtcacgtcatgaacgtgcacatggatcgacccagcgagactgcagcaagtgaattcagtattgaaaagatgaagaactacatcagctactgcaaaatcaaatcggcaccgcgtcttacgaaagaggccgccgagaagctgagcagtcatttcgtcggcatccgatcaactgtcggccacatgcaggaccttgagggcgtgaggacatctattccaatcaccatccgtcaattggaggctatcatccgtatctccgagtctctggccaagatgacgctctcgccccgtgccacagaggaacatgtggatgaggcaattcggctgttcaagttctcgaccatggacgctgtcaatgcaggcactagtaagtctatgcatgcgattgatgatctttcccgtctagagatacgcgatgcgcgccgcaagggaatagaactctctaacctctatccttcctttcattttttttagcggacggacagagtcgtcagcagggtgcagagcaggtccgtcatgtggaggacgcgatccgtcgtcgtgtggctattggatcccagatcccaacagcagtcttggtgcgggagctggagtcgcagggattcaacgcgcgtaatattgagagggccatcttcatgcttgagcgacaggaggtgcttcagtacaccaacatgcgcaagagtgtccgccgccagcgcatgtaagaggggggcaacgctagacggcgagatcgttacaatggatatgaaccgtaattgcataaaagatcatttaaacttaactctggagtgggagcaatttgtttcgaatggcggtctccagccataatgggtttgacacgtcgaacaaggtgagagccttggctcgacgagatgtgacgtcagcctcgcacttgcaggcagcgctatgggtcccgttgcgactccctcggtttgttctcgacctcatcaccttcctgggaaactgctcttccacctagctcgtaccatctcgacacacaggaacgacacctccggccatcgccactcctcatccacttttatcagagaacgcaatcatgggcaagggcttcttctccacgctcctcgtgggcgtcgcgctgctctctgctgccgctgtggtcaccgcagacccaccagaggacgatgatggtctccacccccttcgtacccactccatctacatgccatatatcggtaagcctacccctatatggtagagcctctctgtcgtcttgacattctcacttcatcgcgaaagaagcaagattaggttgaggggaaagaaggttggatgggacacaaggcgacagcgttggatcagaggaacatctcatcccgatccgtttgtgggttaccacactatcctgggcgttgcctcgccctgtatcgattcagcccgttgtcaatggaactttggaccgctgtgtcggctctcgtcccatgtgctactcactcgttgtgttcaggcacccaactaacgcacatactttccgcgtttgctcgcgtgattttattttcgactctatccagatcaggatcttcagaatcgctggttcgactttggcggcgataccatcatcaacaccaacaagcatatccgtctcacgactgatgtcccttcccagaccggatatctctggagtcgtttggtatgtgctttttgtcgcgtttcatggctatggctaccggttgtttcttgtcaaccgatcataccttcagtgcccgcagctccctactcacgcctgagagggacttgtctctctcattctgtagcccattaccgcatccaacttccaagtcgatttcgagttcaaagtggagggcaagggcgacggacttttcggcgacggattcgctgtctggttgaccaaggagcgcgccgaaatgggacctgtctttggaaaccgggacaactttgagggccttggcatctttttcgatacctatgccaattcccgtcaggcggtaaggaactgctttttgctccttatccaccttgctatcaactacgcgttttttccccctacttcttgtatgagggatgcgtgaacatgtgcactttggaactcatctcgtatctgtttttttttaatgaacaaaaaaatctagcactcgtttccatttgtgatggccatgttgggtgatggaagaaccagctacgacggagcgcacgatggcttggccaacaagatcggatcgtgcgaggtcgactttagaggcaagactgttcccaccaagggcaggatcatctaccatcgtgagagtggtcgtttgattgtaagtccatgttctttcatcccgtttcaagggcaccttgttgctgttcttcagcacacacgactgatgcatcacttcattttccatcttgatttctcactaaccatacacacaaaacttacacaccatccatccacacagctcaagacgcagaccaaggcatgggatcagtgggaggactgcttcgatctgtcggatgtcaagttgccccagcttgcctacctcggcttcacctcggtcacgggcgaggtccacgacaaccatgatatcatcagcgttaccaccagcaccatcaccaagggcaactttgctgccaggaagagcaacaacaacacgcctcctcctcagaagaagactggtgtcatgtggtacctcaagttcttggctgcttgcggtgtctttgtggcgctggtcatggccttcaagatgtccaagggcaacaacgacatgaagcgcttctaattgggagcggagaggagaggaaaagggcgtcggggacgttttacaggataaagaagaaaaaaccaacatgtagtcagttagttcgcggctgtgatggaaaagacgcatatcattaacttttggtcatctattcaagaaaagacatggtgcttcaaatctacaggagagtgggctgaggtgaggagcggggggatgtttctgaggtgaagagctggtgttagcaaccaaatgaggataactgagcgagggcgagaggcaggcggagagttggcagaggagaaacagagacgagaaaaagaatctattgagaagatccccggcgaaaacaacaaaggttgacgacacgggtgttgaaggagttgatctaggcttggaagtgctaggacgccttatctgtccgaagaagctccgctacacccgtggcacaatgactcgcatccttcaggagcaacagcgtaaatgctggatggcgcgcaccaatttgttctgcgcctcgttcgatccgggcgacgtagcacaaaggagtgcggttccaggatcgaatagctgcgcttggagggttgtccggcgacgtgtttccctccgccgtgatactccgtgaaaggatgatcggaggaagtatatatgcaccccgtagccccccgggcatgttccttcaagctttgccctgttttgcgaaccaacatcaacggaccctcgtcccgttgcagagacattttttctgcattttctcccagtccctccgaccatatcagtgcacaaccttgccgaacttattcaacacaaaaccccctggcatgttccctcggggtgtaccctgtgtgagaaccaacatcaagggaccatcgtccctcttgcagaagccatttctagcacagacatgtttaaagggcaacttctttctctttttttttctgctttttttctcatatccttcacaccatacccattaaaaatcatgagatatacacccctagcttgctccttctccagtgggccattgccatcacaagagcggctcctgccagcctggacgctctcgatgtttcgaccaagaatgcctacgcaagacgcgatcctctctcggatggtccttccgtttctctaaacaagcgtgctacagatacattattcataacctacgctgatgccactatcagcatatgattgtccagagatggaaggctgctataccttggaagtttttgtagcactgtctgccaccaacagatgcagctttgcggtagctttttcttccgacggcagttgtgggtagcctaatactaagcttgcgggtgggggagtcggtcttcttcaagtcacctccatccactgtcagacatgattgagccaccatcataatcccagacagaccaacgatccctctcgactctgcagagctcataatgagattgttctcttcccttcgaacacaagcatgatccacatgaaatgccctctcatatttttacaacgacaggaaccatttgtccctctacgagaagaccttgggcgcagtgctatgtagtgcaggacactgcacagctgttggtgatgtccatggtgttcatgattgaatgaacgatagattgtttgcttgattttttaattttattttcaccttctctaagaacgcgttacatttctaatgtgctcaaggcgctggcaacgcattgtgcacgccaagaaactgctgggatataataagtagaaactcaagagaagagtgaaagtccagggcataaggggtgtgggaaaagaggataatatacagattttgaaaaagtcagggtgtgagggtgtggaatgagtggaaggtggagtggaggagaaaaaaaaacgagtaagaaatgcaaataagcgaaagcgtgccaaaccgggttcactaggaagggggaaaaaggcctttctttaaaagtcagcatccagggtgaagctgttgttggcgttcttgtccgcgccggcgccagacatgacaccagccttctggtaatccgagacacgcttctcaaagaagttggtcttgccctggagtgagatcaagtccataaagtcgaaggggttctcgacgttgtaatgcttggggttaccgagagcgacgagcagacggtcagcaacaaactcgatgtactgcttcatgagcttggcgttcatgccgatcagcatgacggggagagcatccgtgaggaactcttgctcgatggcgacagcctcggtgatgatgtcacagacacgcttctggtcaggacggctcttcatgagcgagaagagcaagcaggcaaagtcggtgtggagaccctcgtcacgagagatgagctcgttcgagaaggtgaggccgggcatgagaccacgcttcttgagccagaagatggaggcgaacgatccagagaagaagataccttcgacggcggcaaaggcaacaagacgctcagcaaaggtcgagttggcatccgagatccacttcagggcccaggcagccttcttgcgaatgcagggaacttgagaagaaagggagaaggttagcatcctacccaatttttgagcgtaaattaaataatcgacgaaggctcagttgaagacgcgacagcagaaaaacaacagctaagccatgagctgattttcgcgtttcccaaacaaaaaaaaaagggacgaaagagggacgaaaaaagggggacttgagcacgggcttgtgaggcaatggggacttttcagggtaggcgaagtaggatgatccaaatcaattgacgtgtaagagtaaaaaagcgaaggacgaagaacaggcgaagagaatggagcaccggtactgacgcacgggtacgaaataacaagagctgcaaaaaagaaaagggcacacgcaacagcgaacgactagaggcattggtcaacttactggtatcgatggcatcaaagagatgctcacgctgttcaggctccttgacgtatgtgtcaatcaagagcgagtacatctcagagtggacattctcaatcatgatctggaatccgtaaaagcatcttgcctctgggatctggacctcgttcgagaatcgctcaagcaagttctcgttgacaatgccgtcactggcagcgaagaaagccaggatgtgcgagacaaagaatcgctcgtcggcagacatgcggttctcccagtcgtgcatgtccttggagagatcgacctcttcagcagtccagaaggaggcctcagccttcttgtacatctgccagacctcgtggaacttgatggggaagaggacgaagcgacgagggttagggcggaggatgggctcatcctgctcagagaccttcatgtcgttcagcttggaggccaggccggcagcaatctggagatcggcttcgtgggtcttggaggtgtgttcagtcatggtgatggtgatggggttgaaggaagggcgtgtgtggtagctcgagagggttcttgtgaaagtgctatgaaggagaagggagtgggctgggaagtgagaagagagaaagagagaccagccaagttttcgtgggcatgccttttgtagctgtcgagacgcgtctttttgaggtgcgagagaaaacaacaacagtaaacaagcgtgccatggctgaggcaagcgcgacagataagttaagtttgtcaggtcaatttgtcccagtatggaaatactgtcgaccctggtcaaatgaaaattcctccttcttttcccgcccaaaataaaaaaaatgttttgtcagccggtatgagaggggcgaagccaaggtgagagggagagagtgacagtcctccagaactggcaccacggatgagtaaagtggggtgaggcgccgaagaggcggaggctggggcataataaaggtgatgtgtagacgatggttgtgacaaatccagcactcgacaaggggctctcatttcaggatccgcagctacctcaatgatgtctgctgctgttacctttcggtgccgtctagattagagcactagagttgcctgttcactgtcgttataagggcaacaattgcgtggtatcggtgctaggctcttgcagccgtgaacttataatgaccgaatctgtgcagctgcaataaaacagtaaggaggaagagaagaacgagaatggctttgatcacagccgctgttcactgttcatatgtcatacgaagtggcttatccttcaacacccgcacacccgcacaacggcacagcggcacagggcgccaacgatcaaagacccttttttcgattggcggtgggagatagcggcaaatacagtagttgtttcactgcacctcttgcgcttcagtcctgccgcgcaatcaagcgagcaacacatggccaagtcaagtacttcacgactcccggtttactaaaggagatgggtattttgatcgagattttgagcaaagacaagcctggatgcacctatactaccatcttgacctcgttgcccttaatgccgctgtggcctttcacccattgcaccttcacttttcgtccctgatcgacgtaatcatcgtagattctgcaccaccaaggcgacgcggcgattccactgagttgtcgcttagggttcacgttttgccgattggcgatgagactgctgaaggtctttacggctgcgcgaaggtcggtgtggactattacaggcctttgtcgagggctggccagaatggaggctagcagccctacaagttcggcgttgacactattgctgtgccaacgacagggcaggcgcagtaatcgcctcgctttgtggcataaacgctggcgaagccacaactgcgctggtcctccttcacggtcagcgacccgtcgctatagatatggaggggtcccaacatatcgcccatttcctctcgggcaacctctatcatcttgatcgcagggtaatctgaaatgaccggggcttgcctaggtgctactttcttgccgtgctactataaccaggctcgctgccgtgatgagctgtcagctgctgtagtcgcaattgttgagagtgccaaacgaagacaagaggcaagcacaagcacaaggactatcagaatttatgatgtgctgagaaagtcatacgctaattttttttttttgattccacacgactcacaagggacagcgatggaagaatttatttgagaaagacaagcgagaggtatatgtatatggtaatcggtaatcagcaggaaggtgcccgtttcgttatcttccatggggcatagtcagtcttgtgtgcgaacttgcacatctcgtccgccacctcattgcccttggctccgctgtgccccttcacccactggaccgtgatctttcctccttgctgcacatatgcgttgtagatcatgtcccaccatggcgagattgactttcttcgtatgcgggctctctgtgagtggagggtatgacggttgacaacaatcaccttgaaaagggtgacattcgtaaggtagtccgtaaacaccgtcgcagaacgattccgcgggcagaccaggatggaggccagaagtccagccagctcggcgctcaggctggagtaatcgtccgcggtcctgcccaccaccgcacagtcgtaatagtcctcctccttcttgctcaggtagacgctcgagaagctgcagctgggctgtccatttatggtagtcagtgacccatcacagtagatacgtagaggttctgattgatcctccatcgcgacgcgcgcagccctgatgaggctggcagtgaaagagtccacgatgactctggtcgtgcccgctctgatttccattataattgcaagcagaggtctgtgaagacaagattgaattgtaggccaacaagcacggcggagtttttatacccaaaaaaagttgagcaaagccacattgcccttggccgcagcgtggtgaagggcgacgtgcaccccaatcttggaagtacgctcagcccacagcccttcttcgctcaggcgcttctcacgactgcatgctctcgccggtcttgtcctttgcaaaatgccatcggccacttggtgcttgatggtgatggagacaattcttgctgttgctcttcaccatggtggtcatggtgcgccgatgctaggtttgcctacgccttgacccgccattttgcgtcttacacatttgccctttcctgcaactctgctgcaactctgctgcgacaaggctgcaatagtggtttagtagccaaacatattccggaatagaatgcatgcgcactacacgaactgccgttgtgactaatgcaattgctgaggtgtgttgaaggactgctgcattaatcaaagcaacgcgcggctcgatacttcctctgacatattactctgctgcgaggattagatggccaccagtgataggtcaagggacgaggccagagaacgctagatgttcaggcgcggcgctcttccagcaccctgccatgccacccaactatcatcctcctaccacaccgcgctgtttgggacatgcagcccattgagcgccgtctacttgtactccgaactcatctgcagaatcttccttgcgcttctctgctcgcgcgctgaggttgccaattgagctcaagggagaagccgctctcagaggtcgctgcaggtataaaggaggaaagagtttgcatgatcccccgcaactccaaagacgctcttttcgtcgtcgctcgcctttcaagcattcactcttccaagaccgaactacaatgcgttcctccttgctactttacattgcaactgttatgctcggcctcgcctctgaagatattctgagaaaatcctctgctgcggatgctagtcctgtccaagccgatcgcccctgctctttcgccaaaccctgtggtggcggatttcagtgctgtggattgcaagacattggcgacgaaggattttgctaccctggattcggcatctgccctcgtccctccaattagttttcatgaccacctgtatcggcagtatctgagcagcagtagagtattctccataaagctgttaaaagatcctgctgccgggatgataatggcgcgtagcccaacgtctagtgagctgtcgttttgatggatagttactgacgacgaagctgtaatggtcccttcccccctcctcccttgcggcgcaccacccttgccctgttccgcctccttttctttaatgtcgatagagcataaaatgctgtcgtttatgctagtggacaaaagtgcaggccctgctcatcgccccatcaccacccccatgagatgtaaaaaaaaaaaaacaactccttgcccacctgcttctcttttgttctagtttagtacacccactctcaaagttctacctccatgcgctcatcatttttgaccaacgtctcatccgtgctgttactcatactttctggagggttctttgagctcgaacgaggcatctccgttcaactgcacgccaacgcgtcccctatcaaccacgacggggcgcgggcgccctctggtgccggccttgaaagcgatggaccgagttgcggttatccctcaggtctctgtggtcccggattgtactgctgtggccctatgattcaaggccgcagcggaatgtgccttcctatcgatgtgcgatgcaatatcgcatagtttattattttacgttgaacgtctatacatacacaaacacaacaccaatcacaatacatgtattcggaggttcaagtggtctgtaccaggttctgctgccattctttttctaagcactgacttgacaactatggctcttgctcctcacccgtagcgcttattacaaaagtcagattacatcagctccgcagagttgcgatttgggcgctacctcaatagacaaatcagggtgaagtccccaaattatcatcctgtgtcgaaaccctgtacctcaaagtctgtactctctgcctggaaaaacaaggaagcgaatgattttttatgggcgcacgtggactcgagggcgttggcgtgcgtcgctctcacagcaaatgcacggcgactataaaattcagaacggctacacatcgtctgggcgtctgggcgcacgcgatgtagatgagagagcgagaggtaggggacgaacgagcacttggattaaaacttgctcgccatcccgttgcagagaggcaggcgcgctggaagggccaatccctgcaagttgaatcagggtcaatgcaggtgctgcatgcaaggggcggaaccggggttcctgctgcacattggcctttgagagccattatgcttggattggcggggcggtgcgcatgtgatgcattcgggcgatacggatgagaggctgccaaagttcccgtagacatgtgctcgcgaagcgatgaggtgatatcgagtgtgagcgagcgcgccaagttatttctggtcctttgcatgctacttgtacatgcaattgcgacatgagcaaagatataatgaggtactaaggcgaaacggggaagggcgacagacaacacctggaatgcatatgcatagtgtatgatcatgaaatgccaccccaggtctgatccttttatatgcaaaacaatattatcaatcacccaacgaaacactacagacatagtcagcgcaaaggaccatcaacatttccttctgatatctaccgcagaaggccccaggggttgtcactttctgtgtgaatatagatttaacgaaacgtgttctaaagtgtaagaaatcccatacgacttcgagctttgaaagggactctgcattgaccctaattagagttgattaattgagcagagcgaggatcggtgaggttggactaatattgtccgagaaaagagtctgatcaggatgtccatgtggatacttgaacacacaaaaggcagtacctcgcaagattcatcatccggagccatggtgatatgggacaaggaaaggagtaaatgagcaaacgttgagctagcgtgatgagggatttttgcggcacctcagacacgaagactcgtgcacaggagcagctaatccacggttgtgtagctttgcacctggcaccgggatcgcatttttatggacctggatacttaatgcctccttgttgatgtcgctcacaaagttcgacaacattggccagaaggtgagacgcatacattgcggaaggggaagtatatagcgtagagtatgtgagtatgtggtggtggcgagtggaagataacggctattagttggcagaacggaacgtgtgcgtgtgcagctcgcgccatcgaattcctctattctggtgggtacaagtcgcaagccgatgagccgagctcagcacatgtgtacaagcaggcagcgatggcgcacagggtgtgtccccaaaaaataggttcgctcactcagagcctacggaatcactgaagctgagaggatctttttttaagtttgcctcagaaaagatgagcgatgggtcccaagctaagcaaaaaataaaggtacatccaaaagcattatgtaccagtatgcatatatggtgccctgcgtaccaagtatccaggccgcataagtgaccctgctagtaccccgtgccagatgcgagctcttctcgagggtgaggtgcatcaaaatcccttatctgttcgtcatactgctgtttgatcccgcgtcgtatggttcatgtgtactctgcctgaagcaatatcgttgttccctttccaacaagcgttgaccctaagagagctgcatgtgtgacgccgaaaatgtccttcatagattgtgctagaaaaagaactggagtttgcgtctgtgagagcgcatgtacggcagcgaggatgcctgatactaagagccaggaggcgcaaccctttcctctgatggacaattaggcggcaaagctgatatgactcctggctgcaagcattgtctcggaaatgaaaaagggtcgaaaggcataaacagcatccattttggggatggtcaagacgtcgtcaaagtcgtcggccagtcatctacgctcccgctcttctgtatttttcaacgtctatacttgacgcactgtccacgaaaggttttattgcgcaggcatcattaggaacaaatggagtcgtcgcctttgattatcaatcatcaactctccgaattcacctactgtagccttccgagtctacgctggaactgaatgtgaatctctattagtgcgtgtttacttaacctgcccagcatgggccccactttaaaaacgcgagggacaatttcggacgtgctcagaagtagcgtcagtgttgtgtactttgtaggcatgcccaattaaccctgtgtggagctgaaggcacaggctaactctctataggctccgtgggcaaagcaaatatccctctctctgtctttcagtccacatgtgtgtcacagagtaggggccaataattgcccttcatgctccatgacctcgatgatgcaactgtcattgccggcaaaaaacaatcctggctcccgaaaggcctcaccacggttcctaatcacattactcggcataggcagtgtgcatgtgcatcaaaggaaggaatcagttaaagcgctggagatcacttgggtgccctcatcccgtcctgatgtggtgtacctgaaagcacagtcgacccttttatatatatgttttctattgattttcgaatacactattttacaatgagagctggcttgttgctgttcaaacttggcttgctttagtgacatgtgtaggtagattgtctgttacagctctttaatgtttttttttcgccaacatataacaaggccacctttgattcatctccttcaatttttcttccttcatccttctattcatcgtttatccatagctgcctttgtccattttcatatccaacgttcgattcccccacccccctctacaccaaattacccttgaagggacagaaattattttgtccttgacccttggaccctcattcactcagctccccacgcatttgtcccgcaccctggttcactaccatcccatcctgtcaaacattccttgctaatcttcggcattctggtccatactgttgaggagaacagacacgctcctgatatcattttggcgataacattatgggtgtctttggcgagaaacatacatcgctaacgcgcgagcaaaagcgccagctgatccatcaagcagacacgcacaaactgcggccaacagaggtatgcgattgggtcctcgcaacatggggacttcggatcgcccgggtgaccgtttactcgatattgcacaagcagcgtgcctcgctcatggctggccacaaggacctctaccagtccatgcaaagcagatcaggcacctcggacgttttcacaaatctcaatgcaggcaccgacgatgcctgtctggacaggaacacagatactggacgcgtgacaaagtatcgtggtggcgcaggtagtaaacgttcgcgaagtactggcagcaatggcatcgtaggcgatctgccgcatccgatccagtttccctctcagggcgaaggtaattaatcaactagatcctggttcacctacctgcaatcacatctttttgttccacccctcgtcctctccaccagagtaccacatctcgttgcgccgttctgaaggatgggaggggcgggaaggcatgcgttgctgaatttgtaagaaaaaacgatggattatcaataggaaggtactgatgaaaaggataccttaatcaatgcagccgtcgatccaagcgacttcctggtgtttccaaatgtgcattgctcttcttgttgcttgttttttttacgttctccacatttagcaactgggggagtgggggcttattcaatccggtgtctttcaatggagcgtccactgcagtcgcgtcattgcaattgagtaatgcttaagcactggaggtatatttgtttatgatccaataggcacctgcatgcaagtttgttggtgctctcaatttttgcatcacacgttctgtgttgctcctgcgtttcccctcattttctccccaactgtcggctcgcttcccgctcggcttacaataatctcgtcagatcttgcatgtacattagctttgtattctaattcctgctttcaatcccccaaaaccttaactaggcgcccgttgggaagggcaactgaagcgtgtgcgcgagccagcctcggttgagctggaccgagccatggttcagttcctaaaatccccagcagctgtcgactcgcacggccgtcgactcaacgatgcagagcttcagtcgcacgccctgcgtcttgctcggacaattcccagcgcaagccggatgagatgttccttcggctggcttcgacatttcaagcggaggctgggcgtgcagtgggccgcggatcggctcggccggtacagatggatcgtcgagatggacccttccgcatcggccacctcaccttctccctccacatcaccctcgttgacctcgttatcatcgacgtcgcacatagaaggcttgtctgcttcgccgactgcatctgattcgacacccttctcggctgaccccggcctctcagcaggtcatggtcaccgccatcagagctttcatcgtcgccttagtcatccgcaatcccaacgccaaggcaacgtcaaagaggagctcgacgacagtgacaacagagacacccaattacgcaaccactatcaacaccaacaactctatgcatatggaccagcccaagacactggggcacaggatgagaacggaccccagtctagccaggaactgctggggagggattatgacttctcgagtcaagtatccaacagcatcagcgccaatgtttttgcaggtgcagacaggcatatgagatcaacatcgacttgcaccaaccagtcctacactccgggacttaaccttggacccaactatcagcagcaacaacagcaacagcaggcgcgtcttcagccgcgcaggctctattcctttagcgagtcgtcgcccttcccaccactcggaggaccattcacctcggcgacttcatccattcctcagcctgcgtcgcatgtgccgtcgtcgtctctcgcccatccatcccacagcaccttccttaacctccagtcgccactgtcctcgctctcccagggttcgcaacagtcgcagcagtctcaacaatcgatccttgactcatttccgaatctattcgattcgcttccgcccttgcacagcagcggcacgagcagctccagcattcccgcatccgttccatcgtcgcagatcatacttcagagccagcagccattggcgcccatgagcgggcctccttcgactacaactgctggagcatctgctggtgcaaagctcagtccatcgccctttggactgacgactgacggcggtatgcgcaaggtcccaaacaaggacgaagcatacgagatgctccaaggtctgctcctgtattatgagcaggacaaccacagttacacgggcgaacagcagacgcttcttcttccgagatggattcaccagcagcgtcagatcatgcaacactcgggcacaggtgacgcgaggatggtctggatgcgccagcaacagatcccctcgctggcctcacaaccacaatcacagcaatacagccagcaaagccagacgtctccttcctcgccaccctcgttctcgtcctcttcagccccgcagcccccgtcgccgttctcacagcaactgatgtcgcttcagaccgcaacccagacgcaacacccgaatcacccgctctcggcccaatcgctgtcccacccgcactcaaactttcctcaggcacagcagtattcgccagcggcatcagttgccgtgggcgcaaccccttcccctcagcatcgcgcctcctcgctcggctcctcacctccactttcgcccctgtctacagccagcccggcgacgagcacgatcacggtggcgtccatgacagggtcagcaaattacgggggcacgcccgtctcgggatccatgggtctcagcagccctggtggcggtgcaagcggtcccgcagggttggaccaccagcatgcccaatccttccaagtcaattctggatacccttcactgacatctacctttgagcaacagatgttctatgctcatcaccaacatgtgcttcagcagcagtttgcactgcaccatcaacaccaacaacagatgcagcagcaacagcagcagcagcagcaacaacaacaacaacaacaccagcatcgtcagagacagcagcagcagcagtagtaatagtaatagtagtagtcatagtgtacaatatagcatccatctattcatccatcttggcagtccttgacttcaaaacgtgttttttatgtctttatctttctttcacacctctctctctcaccgccttgacagctctactgacaggcctgatcgctccatgggtgttctgggtcgatcaatggaggccctcgccatttcgatcgattttttcgccaaactcaaggacgattcaccccacgactccaattccaagctcgtccgcgacatggagtacggtcctacccggtacagcgtcggtcgagacaccgtcgtcacgagattggccgtcgcaggtgctgtcagcgatgtggtggaagagccagcggcacgatgtttaaacactggcgaacttgaacggttgccggcttggtccatggacatcaacgtcgacgtgctcgctgtccagctgcatttcggttgttgataaacctgcgccttggcgtgagcggtgccctgcctgacttgtggcccctcgtcctcctcctcgtcctccgaatcatcagagtcgtgctccggggaactgacatccgtcgaggccccgttacgtgcctcgactcttgtagcatccattctcgggtctgggtcattcgagaagcggttgttgactttagagcgcttctggccttcgaatagcgagtgtcctgtcctgagcgatacgccaagtggagacatcgtaccttccgaatctggcatggccgccttgacagatgggaacgtgcgaggtccgtcaccattggcgctgctgctgagagactctccttgtatcaaaaaagaggaggaagggcccgaagctcgcaatggggacgttgttcggggaggggcttgggaataggacgcgacggacgatcgaggagtgccctgtaaagacgctgtcaaatcctcaatcatgtcgtcgatcctcaacgcgttcaaatggtccatctcacaggttccgtctgtacatgcgtcgcgtgaacgacctatgctgttattgccgagcagcatagcaacgtgcatggcagagaccgagccatcagaaagcttccggaacggtgttgtcgacacccgcgcgagggacggagaggagccactctgatgtttgtaactggggttgacaggtcgactggtcaaaatgcgctgcgagagacacggagatgttgtagcagaggagcacttagaggctacaggagacggtacaccagagcccataaaggttgcatagggtggatccaacatggtgcatagacaagagggatcatcatggctggcgagatcccgggtacaggttaggcgggatgaaggtgagattgaagactcaggcgttggaaggtatcgctcttgatggccagctgcgtcgttagaaatgtgtgatgcaaggacggtgtgcggctgctctgtccgatttatcgcacccaaagggtcgaccgagtacgatcgagtatgtgttcttgaaaccaccttggaccggttcgctttgacccgctggtggctctctgcgattcccttgaacaatgaattatactgctcaatctcggtcctgccaggctgatacaccgcggaaattgtcctgccgacagctgcatcctgctcagtttgactgtactcaaagaaggaccgtccatcgctctccaggcttgccggcggctgatagcacgggtcagttagttcaggcaagacgccggagtcaggtctgcagctgcccatggactgctgggcagtcggcgaagtgcattcatgaccctcgccggctggaaattcatgctgcatgcgccatttttcgaggccactttcgcctagagtatagtcaggagcgaacctgggagtgcgtggatatgcatcattatagccttggttgtcttccccatagacctgctgatgagagagtgccccgttttgatagaactgcagctgcggctgctctcttcgcatagaatggcgggtggtgatcaaaactggcgatgtcacagcggccatggtgctcgggtgcatgatcggagatctagtgttggagtaaagcgatcggcaagtagacgctcttgattattaattataatgtgcctcgcactgccattggtaaggttataaactgcagttgcttccatacctagataactcggtggtgctggattgcttcaacaattgctgcgagctcaaagcaggagatggataagctgagacagggtcttggtagtgctggtctggttgaagatagtgcaaggatagatatggcagctggaacgacgaatgatccaattcaagagccagatgctgctgctgctgttgctggcaaaactgttgcgcgattcgagcttttgactgtgtacgggcatcctctcccgagttggcaagttccacatcaatgttcggcagagtgggctttggtcgaggaggtttcgagcgacctggtcgagattgagggcgcgaggcactgcaggttctaccagacccgggatcggcatcatctgaagggtatctggcatgtcctcgctggttaaattgaatcccgcttgcgcgctgttttacaatctttcgtaccatggtgtcaattcttttgttcatctcacgggagacaaagcttttgggactgacttgaagtttggaagaaagcaggatccacagcaccatagcggcgagggttgccaatacggagcagatgaacataacgagagtgaacatcataacgctgaacgtaaagacatcggcgttcttcagctctgggaaaagctgaccgatgtcgtccagacgatcgatatcaaacccgatggccgccatgaatgcaaggagtgtcatgatgttgatgatctgccgcggcgtttgtattgccaggaacttccatcctagaacacgacacgcgaaccaaagttgatcagagacatgcttcattaaaattgaaattgcaacacgctcactgagaccttcccgacggttccgttggtgacaacataaggcgtcgttttatgctctttaccttttagctgggagacgaccaggaacgatagcctctcgcggagctttttagagtctcggatcgcctcgatgaagcaaaagtaattgtaatcttgtagacgatagaactcgcccgcaaccttgttcgaaactgcagacgagatacacctgctcttgaccaccttattggcctttatgaactcgagggccaacagcacacatgagagtaggatgctcgcggaaaatatccatcgtgcaaccgaaacgtcgatagcaagcgtggctgaggatgtggaccaagtggggccgtagacgagaagaatggtgcaggtccagatttctccacagaacgccagtatagctccgataaacatgatccacacccaggtgtaatgcaggtgagcccaaaccgagtcatcgcgaaagtcaagaacattgatagaatcgaatgtatgcaagggctcggcctcttccatcctgtccgagggtgccatcgtgtgctgcgtgccttgatgagagttgatggtgctgctttgtagtgagaacacgaaggattgaaagaacaagagggatcgagagatcgctcctttggttggtggactgtgcgttgagaagcagcgcggacggtggtacagaaaatacagacagaaggcaatgtcgcgagaagtgaatggcggcagtaaatgaggcaatgtcgaagagctagcgtccagcgtccagcgtcgaacgcgcagcgaacaagatgctcgaggcgagagagagagagagagagagagagagagagagagagagagagagagagagagagagagagagagagagagagagagagagagcgagagcgagggatgagatgagacgagaagaggagagaaggtgtcgatcgaggagcactgatcaggtggagaggcaaaacgagcaaaacgagcaaaacgagcacaatggacaagggacagaagcaagagactgttgcaagtctatttcagggcacaggcaataaaaaagctctctttcaatctatagaggttgttgctatgtccattagttcattttaaaggggggctggctgctgatcaagcgcgcgaatagactttttggtggtcgcacaaacacaaacgcatctttctctcctcctctctctctttcattcccattctccttctttcaggaaaaaaaaaaaaaaaacaagaacagcacgcgtagacttttctcagagtaaaatgctaaattcaactatgcgtttaatcgctgctttctcgtacggcaccagcgttccggacgccgaggccgatgacattatatggtacagggggtgagggcggcgtgctccgtagatcagcgtcgtcctgcctcgtgctcggactctggtcatggccgtggtcgtgatcgtgctcgtggtcatagtcttggtcgcgattctgatccagtgagggacttgatccaggagtaaagatgcgcaactctgggataagaagaggctctgcaaggaaggttgagtttgaatcgcacgttctctcggccttggtaaagcgcacattcaaggtcggctgtccagagatttgtgtcgggccatcagccactgcagcggtttcgcccggcggcaaagccacactgaatagtcctggcaaaggcgacgagaagggctgagaagaggtagcaaaggtagaggaggaggacggcattggcggcgatgattcggtgatggagaacgcgggcaggccactgatcggagaaactgggtgattcgagtccgcagtcgtggtgggcgagggcagcacagctgttggattcaagatactgctgttgatgtcgccagcagtgtgatccatagggcgccggtgggaaaagagaacactcttggaccgccgttccttggctgtggagggcgggggcgaacccagaaggaacgggacagtgtcattctcttctgctcgctccaaactcgtcctgaactgatgactgccaccagcaacggccgagggcaaagggtgaataggcgaagatgccaagtatgactgatcctggatcgtgatcgaaggcgttgttcgagccggaaccgtgagacttggccggctttggtgagagcgcgaactgtcgttcaaattcagttgctcaccctcaggatattgggtcaagcctgccagggacgacgggtcactcgctgctgtgctcacgccatccaccacaggctgcgtaacaggggtggtgggtgctgcagtggtagttggaggatcggctcctgacaatgggacagtgccgattgagaactccgaagggaaacacgcgagcacaagtctagtctcctcttctacgttttgcagaaagatcttggtccttgcattgaggcacgccattctgtgaccgagcggatcgtgagccgacaaactcgaacgcctacgactcattgcgctgctgccggctccttcgtcagcggtgcgtccacacgcagaccgattgctctgtgctccctgacggctaaacactcccggactacgcgccgccgtcggagtgagctctgctgccgcttccagctgcgggatcgaatccagttttggtgatggcgcggtgacaatctttggcttcaagataccgcgacccttcttggaagacggaccgctcatggggtctggtggaggcgacaaggtcgaattcgaagtaatgacactcggcattgacagatgctcggttccgcgactcggggttggcgggctagagactgcaaaatacgagtcttcgacttcaaagtccgagctttgcatacgaccagcagagtcgcgagaactaatctgatctgtaagacctctgcttgctgtaggagatgtgcctggtaccatcaaagaggtcgactgtgtgtttcgtgacagaaaaggcgacgacccagggctgtcggtgccggtcgaagacgacgcaggtgccctgagtgcggcttctctcgccaagtacatggaaccgaacccaggactgacgggttgcctctcatacttgccaggaagaagaaactgcggatgatcgttgccaagagctgattctgctgtcgagacctggcttggctctcgccggtcaccatgcactgccatcgatggtgacaagctcgttgacccggacctcttctcaggatacataggcactccgaattctgagaacgctgtcattccgtccgaggtcgtattcaccatgatgcgcacatgatccatcgatctttttgcgcgatcacccaagagctttggcagcacttgctcagcgcctttggaagcagaatctgagcgctgagttctttgaagacgtgcgtgatgtatcgagaccctcggggtgttgttgggaccgccgccactactctgctcggagattgacacgaagctgcgttgccgttgatgaccccttgaagacggcaggcgcggtgacatcggcggggtcgcagccaagcgcatgggctcttccatcgcagccaacgcaatcatggtctgtgcgggctgtgcaggtttactccagcttttccactgcctgcgccgctcatccctctgcttccgcggagcaactgtggtgtcgtggccggggtcgctcgtactgtgatcgtgatcggctccgagatgctgcggtgatgatgctggggatgaatgatctccgaactgtcgctctggcgcgaatgaaggtgaaggccaataaaacgctggagaattggctctggagctacctgctgatcgactttggcggatggacgaaacttgaggctgcgcatccagcagtcgaagttggtctagcagaaacgggcgcatcatgatcatcaatggtagacggttgaaaagaatagtctccgcaaaggaccataaaatataaccaagtgcggtcgcaggaagattttccttcgtgtgtactgatccaggaatgggagtcatctcagcagaagagcgcataaatgaaggaaaggacgcgaatcctcctatggagtgtcgaggggtcatagggccgtccgcacgaggtgtcgtaggaaagggagtactgagaaggagaggcgaagacggtcctgaaccattggatgcactgtgcagacgcggaccacctgctcccatcagtgagctaccgacaaaggcgtgtgccgaaaagtacttcctgacgatgttgaaaatatcaagccaacatccagggtgataggacaggtagcgttccccgcgtaccatgatgatccgtagtgcaataaagtcgacaatgagacctggggatgcgttcatggaacattcttgccgaacctgcgatacctctgtttcgtggtcgtgctcatggtcatggtcgtggtcgttgatctgtagagaaggcatcctcgtatggataggagtttgaggcgagacaccagcagacggcggagctaaaaatccagacataggcggctgctgttgctggggagacgctggaactgaaatatcgatcgagggtcttttcttagtggcgcgcgccgcattcagcatgggcgccaagagtccggctgtgcgcgaggaccttctcgacatgggatcgaattctgccgccttgacagtaaggccaaggagcctcagccagaactgcatctcgaggatgtcgaggcaattggcatggaatcgggacttgaatcgaaggcacaaggggatgacaatgtaagccatgaagcgcggtgttggcgtgctctgctccagttctgcgaggatatccgtgtccgcaaagttgatcatggctagcactaggtccacgacactgctgctaaatctcgcctgggagacgtgtgagctctccaccgcccaatcacccttcactgctgccatcaacgcggggttggcaactttgtcccggaggacggcggacagctcagtcgagttccggagcagctgacggtcatcctcgacaaccaaggtcaatccgtccaacaatccagaaaagtcgatgaccttgtactgcgagcgcagcgcatgggcaaactggacgatcacgtatatcgccgcacgactgcactgctgagaattccggatcggcaaaactacgcacttaagatagtccttgatccactcggttgtgcatacgatcttgagcagcatgtaatccttaacgatcgaccgaaccaacgtcgccatccgctggtgctgcacgtcagccagttgtcctccgtgatcgcagaacagttgtacgaggcatatgaactcgtgcttgatggcaacgcggtcgttttgcgcccatgtcttgcccttgatggcctggaccttggagagcggacttgggaaaagggcaaagcggctgatatcacacaggctgtcctcggtatcctgtgtctgtcgtggagcgactggaggtgggacaaaggagggcggcaccagaggcttggaggatcgcgcgaacctggcaaagatctcgatcaagctgtccagcccactcgtcatgaggctctcttcccgttccagaaacaagggcagtagttgtcgcaacaccctgacaaattgctcggaccgtagtgagcctgggtcatatgctatcacggacaggaagagcttgattgaatccgccatcgagaattcccgcttttgtagcacattactactctgcaagagcttcgaatcctttggaataagcgaagaaatccactgaggaatctcaagttgtggaccaccgtaggtgcttcgctcgtggtaagcctctgatagtgactggacgccgagcgcctttgagtgctgggtggtcgtgggctggtcgagagcctccagaaaagaaaataaacctctggccatgatggcagactgctcactcgacatgttgcggagcatcagcggaacgatcgcgcccaagctttgcagcacaaatgcttcctgatgcagcagataaaagcgatagaaggctgcgtcaatcgtgtcgcggatagcagcaatcctcgccgagtcgcagtaggtcttaaatagcgcacagaagaaaaggccataaccgttctgcgacgaaaagaagcgcctcagacgtgtagccgccgtcacgtacacatccagggcttggccaacaatagccaaatcactgccgtgctcgagcaaaatcacgttgacgccgttgagaatgttcataagctccagtcgctcggcgctctttttgtccattttctgaatcaggttgagcacaaagtgaagccatacgcgagcccgaagggaggacaaggatctcaagttgcgattctgagaggccagggcagcaatgaactgcgcctgtgtggcagatgtgtccggaaggtactggctgtcctccagcttagggcctgcagcaactgagtcggtgacgtcaagtctaggcatcctgctgaatcgaccgatgcttgatttgatgtcgggttcttccagtggatagcggtagaggaatgtggtcatgaactggatctgattgatgttgatcaaggtcatctggaacaactgctgggggacgcccaatcgcgcgaggacctgctcaggcgaggtgagtcggttcgggaacatcgactcgggtatgatgtggggcttgaaccagaaacgtcccagtgcagcaaagaagacatcgaccttgtttcgcttgaagtctttgaacacgatgtcatttgtcgaggagacgacgtcagccagtagcgggaggatgattgtgagcatctcgaagcctaggggcttggagtttctctggaaccacttcaagagtccaaggaggtggttgaatagggcataggcaaacgctgcggggagcctggaactgtagctgagaagcaggtgcagacgtgagacgaggtcgcgttgtcggtccggcctagcatgcacgatctctgaaaaaaaaggatctgacaaacagcaccggttcattgcgcatgtagtccgagagaaagttgaccactgcagcacgaactccaatggctttatcgttcagcagatcgatggtgcctagattgagcgagttgagcactggaatcaaaacggtggcgtgtcgatccttcggcaagacggtgtaggtccgtccaaaattagccttgctctcgtagtcttcatcaagatagcctgtccacgagagcattaatggcgtctgcgcacgccgagtcatctcaatctccacatgatcctcttcgccccatcccgactctctaaagcgattgcgaatgtccggaggaaagttccctgcgcttttcagctctgtgagccaccgtggttcgtccatggtatagcggttgctacccacttcagaggtcacaaacggcacctggatggtgccgttacggaaggggcctctggaagacggatcaatgacatatggctgtgacagtagctcattccgatggtcaaatagaatgttgagtcgttccacagcactaagacgcgtgtaaggaccctcactaaagcgcgaaaaaggtggggggattagttgctgattgataatctatcagaagtgacctcagatagacatcagagccagtggccacttacttgatcaggtcgcgagacaccaaagtgtagatagttttaggtgcaatgtctgcgcacttgacaaaaaggaatgcagacaacgatgtcaccctcggacgcgactccaggcaatagacgttccagaggggctcgacaagcatcaagtactcactcgcatgaatcgcagagtgcactgttatcaacaacatcaagacagtcaccgtctcatcaagtcgcacgtctgggattctgccagtgcgactttgctgagaatagctcctggttgtgctgtggggcgaccccatcttgctgctatgagtggacaagatggggctcccgctggttgaccgtgcgatgctgtcgatgccaagtgagtaccgatctcggtgctatttggtgtgatagaggcataacgtaaaagtgaagctgtcaatgccaaatatcacaaaaatgaggtccagaaagacagcaagccttatcattttcaatacctcgcccaggagcgtgtcaacgctattataaatgtgtctaatccttagaaggattgtttcagatatgccggaggggccgccatgagtgccacattccgagggaagatcaaggttgatggcccagtcaaggactcgaggtaaccagcctggtctaagtgtgcgggaacacaaccagttagcgttgcttcttgatagagggcccttccacagacagcgtgagcgtggttgtttcgcacgcgatatcttacctgtggattgttttgcacaacatccgaatctcatagaagatcaagcagagcatgattcgtatcggccgagggacaagtattcttcgttcctataaatttcaacatcgagacataacgtcaaaatgaaacgggcagtcagtaccggaaatcactacatctcatgaactctgggaggcctgtagaccagctccgtatgtaaatgtaccttggataccaagtacagtcccagttttcgctctagatcgatcaaaaacatctttccgatctctgtctcgtgattatcgccacctttcgccagccgcttgatcgcttggatgaactccaacaaaataacacattgaccgagtgtacaacttccccatctcagcgcttgggtctggaggtcagagcggggtctttcagcgccaacatcggtcatagcaatgacgcaaatcatgtcgacgtctttcatatagaggtccaccagccccagatgagcctccaagcaggacagaatacaaaggtagtccgtgacaacttgagtagagtccgatgccacacaggctatcatgggcttgaagaatgttgctcggtgctggacagaaaactgcagtaggagcatcgaaagtcgctcactcggctcgggttgatgagcgaccattttctattggtaagagaggaatgatacaaattagactattagatgcgttggaccaaaaaaactcctgtgtatcgaaaaaaaacattcacgctgagtgggaggccggacatacgttcaagaaagtggagagtgttgaagagagaatagaagcactcatcaattttgcagatccgagtatgatgtggtaataaaggttgaccaccctcctaaatgaagtgttttcgcactgtcggtcagggcaaggccattgcatatgttagtcacagtggcatgtgttggtggcaagggtcatcctgttacttgagaccaacggccttgatcacacatagtcacctcgttcttaagcccttcacttatagctttctgatacccatgttgccatagactgttcaggtaggttcgtgcatgcctcaagactgggctcagttgctcttcagcagcgatgttgggaggctggagtggttgtgatgaggaccggagattctcgttgctggcatttggactcctgggtgaccgcggcggcgtccttgagtgaaggtctgaatcagtgtcggacgatatagaaatgcgtgggctttcatcctgaccttccttggaagttctgggcctttctatagagaccttcgccggctgtgtagtctcagagaactccatcgaaaatattgccaggatgaacctgatgagcatggcaatggcctcgtccgaaaccgctcctgacagtccggctggctggagaaattcctgaagaaagagtaccaggtcgagaatgagagactttgagagctccgagccatctgcatatgctattggagcattcagcacaatctcactcgcagcttgtccaagttgtcgcacaggtccatccatagcagctgggtattttgaatttggctccatccaatatttctattggaaatttaagatgcgttacagagatgttttgcgtcgcagtggcaatcgaccgctctcgaatcaatatttgccgcaaactcactggaatcaactcgtggagcaggaaatgaacgacgctctggtcgcgcgaccgaaggcattcgatgaggccgcgtaaaaaggcgatctgagataaatgttcctgtcgaagccgttcgcctcctgttgccttaccaacacccaagtctccggttcgtatccgttccattgtctccgcaacgaatgtctgcagattttgatctttacgttcctcgggcagctgttcttgctcgctggacaaaacgatcagagcggatagcaatatgtgaatatttcttggtgatagcggcaggctcgcagtgcaaactttagggctcagcagctctcgggtgattgcgatgacccgttcctaatgtgagtacgaaagtgtttgaaagggtctgtgttaggacattttgcagatcgtctcctgatagtgaatggtactgaacgagcgatgttgcaccttcttgcactcatatctttgtgataacagatcaaggcaccacaagatgtcctgcaagttgtctgggtcgctttgtagtggaaacattcgccgcatttgttcaaagaagctcagcacggctgtcgagtcggcacctaaaagcagcaaaagagcactatgtgagtaagcgccatgttgagtcaaaaaatctaggtcccttttccaccacagcgttatcaaaaaacccgttcgactcttacgggacaaaggctctggtcgatctgccagcagcatcttgccaaggctcttcaatatgtcagtcttgcatggcacctccaccataagggtcttccagcgattcaaaatgtcgaccagttcatcgacaagcgccctgtcaacagacgtaatgtcctgctgcatggccatcagattgtacgtgttcccagagatcattcctcgcgcgccggttccgatccttgctacggttcgagcgcgaggttgactctggtcgttaatgtgcctagaaagagccttctcaacttccttctccatcttccgaagttgagtccgttgcacaaccaccgtccgaaagccgagaacgccgcgaagaccagttgaaaccgggcctgagccctccatcggtggataggtcgatttgggttgctctgggacgatagtggttgatctagaggccggcttgagatggctcgagtccgttgagcttctcaagacgctggtattcccgttgctgctgggcagatccgtcatagagttgacagctgcttggcgggtttgtaggacagagtcgctccctatcattttttgtcggacgcgagcccagtttctgtcgacacggggcagggttggagttgtcctttctagggcgcctggcagctctagtgtaggtgcggaaggcacggccgcggtcggctgttcctgtggcggggacgactgcatggtgtcagggtctatgggtataggttgtttctgtgacatggttgcactgaatttagggctgagttcttgcggcaccaggtggctctgacccgtctggatggccgccatcaacagacccgaatgaagctgaggcgagtctgcagagctggttgggattatgcggtgtggtgctggtgggttgtagatggagaggtggttgataatacagcggagtggtgggacagattagcccatggtcatgacggatactgtggatgcacaacggggacagtggagagagactatatgccggcgaggaagcgctcttccaaagggctggaggacgagagacggaggacgggggacggaggacggaggacggatggatgctgaggatgcagtgggatgagcaacagagtaagctggaggaatgtgaatgagcttgacagaagaagaggattcagacgcaagggaacgacgagggctgaaagaaagaagtttaaaaaaaagtgcccgttgagccgttgttgcaccgctgaatatataccctactggatatatgacatcccccttatcgcattcacccgcaggctgggtgctcctatggccccagagacgagagggtcctcgtgcttgactgtctggattgaataacgaaaaaaagagtccgcagcgatagacacggatgcgtcttttcgggtccctgtcgacactgagaggagaggcatgccctgtctgtctatatgtgagtctattctgcgggcttgcctgcaggcctgcctggatatgcaggatgcatcgggggttgccagaccagagcaggcgcggagaggccctctgtgctgcgctgtgctgtgctgtccatcgctgttgacctgcgcagacccgtcgtcgcctccaccccccttcgtcgatctaaacagtcgtggtactgggtcaaccatcccttgaggtccagctgtccacttgatgcggctgtgtccatatttggcgtggagcgtcgcacagatctttccagttacggttcgctagccttgtggccaccgccccttcaagcttcatcctgcctctcgcatgccactcgtctcgttcatcctacccatcggtgtcgacaccatggctgcttgtgaccaaaagccagagaatcgaaccggacacagatgcacacggatggggcgttggggtcctggtgatttattccagcgtggtccgagatgatggttgttcctgtcttctctaccacgctggtgattcttaaccacccgtggctattcacagcccgtgttcccgacagacattctactctggtcttctgtagaaataaactataaccgcgcatccatggacacgttgctatcatctgaatgttactgccacctgacttgtcccagttcattaccagaccctacaaaccaaaatcccaagaggcgggatcgcttggcaacatcgtcctagcaccacaaggatcagaagaaccagctcttgggcttaggcctcgctcactcgcccaatgaacaaacatgccatcctcatcctattcgtcctggccacaggcgcaggaaaatcagttacgggatgatcatgcttgaagctccttgcttagaccattgtcctatccggtgtgaaccattatcccgatacagctgtgttgcctccttagaaactgccaggcagctcgattttcacagacaaagctcacactgtgctcaagggccttactgtggaaccggctagcaacagccattttcaaccacggcggcatataaatgtcaaacctcccttcttttttcattcttctatattttaagcacagcgacaatagacacgctcacgagcatcgcccttgttccttgacacatttgctctcttgaccctttaagtgtcctttttacccgagcagccgtctgcaaccgcgcgcatccaactcctttccaactcctcggacacaccccactcgacgcctctttttgccttcctcttctcttgcgtcctttttacgaccagttgctgaacttgcacttccccactcctctcatccgctttctgccctcgtccaaaagtggacgcacactgctgccatgcggacacagaatagcgacctttctcactccacgcctgccaccatgacgctctctgtcgtgtttatgaccctctgtatactcttgctccacccatccatctcttccgcacacagctggctcgactgcaccaatatgctggattcgggctgtgcgggcttcccactgggttatccctccaggggcgatagagacatcaatacgaaatatacatacctcgttcaggaccgccgacccgatgccccagtatgtcaacctggtcgacaattcccaggcaataaccccttccctccagcgactgtcacaccaggacagaccatgctcctcacttggcagcccgatggacacctcgacgacggccacccctctacgattgaggttcattggtcgggtgttcctggaaagcagcttcaagtgcgctcggagcttggtcctgcgaccttgcttggcaccatgatctttgctacatccaacaactgtgatcgggcatgggacccgaacacatggtgccgtggccaaatcaccatcccggcgagtacgcagccaggcacgtatcagctagtatggtggtggaaatatgaccggaatccatctggtgaggagtactcgacctgctttgaaattgtggtaggcggtggcggcatcttgccacgcgaaatagaggtgagagcgcagggccaggaccctgttcacgcgccgagtgtggcttctttgtcttcccctgcgtcggtcccagctcttgacagcacttctacaccgcaagctctccagttggcctacatgacttcagactctgaagcgagtgagggcagcgatccagtgccagtcgaaagcgatgctcacgaagaagaatcgttgacgagtctgacagcacagccagatgaaccgctgtcggtcgttcccgacgcgtccatcaaggacgacaacaagcagggccggcacaagacgaacggctatctcgatgacgacactggagcgttggcaggagatgccatcaatgatgacgaaggcgaggatacctcaccactccctgtcgtgtcaccctcgcagctcatcaacagcacgcttgcagagcagcttcaaaccaattctagcacgagtcatggcagcggaggaggcccattggctcatgcagcacccggtggcaccaggagtaattctacagggttgccacctgtccagcccaaagcgccggctgaaggcagtagtgcccgcgaccggactcttgtggggctgcccccactggacagtggcacgtctgaggtgtgggtgtcctctgtgtcctgtggatgtctcgttctcgcgagtgtcctgacgacggctttcttgttcacgtagacgaataaacgcgcgagaccccatgtgcccgtgtcggagtgcaggggtggcacaggccctccgtgaatgcatacgtgagggtgcaagcgaggccatcgctttgctccaggccataaactcagtttcaggctttcagctccattgcatttcatagccctcctgcagacagcagagctcttttttttcgctttttcttgttgtctttatttttcgttgtctcggtgtcaccccagttcacgctctgttcgccttcgcgtccttgcaatcagccagtccatcctgtcatcattccagcctgtcatcgtcttgcatcctcatccctcgtcttgctcgctcgtccttgcacacactcactctctctctttctctttctctcacacacaaagacactaacacacacacacacacacacacacacacacacacacacacacactccctcacacctacagaaaagagaacaccaggtccgtctcctttccccttgtgtgccagcatgtgtcggagtgtgcctgcatacgactgcagcaccccgtccacagacacacgcacactcacgccctgcaaaacgtccctcagaccccatccctacgcgtgccgatgtgttttgcattctcccctgtctcatgatccaccctcgcatccatccttccttcgccccttccttgctcgccctgtctaccagcattccacgcacgcgaggatcgccctgacatggcttgcatgggtgtgctcgctcgctctcgcttttcaccaagctgcagaaatatgtaaaggctaactttgtctcctgattttgccctctttttttgtcccgcctttttttttttttttttttttcttttcttttcttttctgctgttctcctcccccgcccctcgctcatctcctgctgccccccgaccatctcctattgccatccaccacacagacataccgaccgaatccaaagcgtgcgtgcagcactaccacaaccacacccacatccatagctgggtccaacacgcgaaaccaacaaccgcgatgcaagcatgtcccggacaggaaatatcatggccagcatctatactcagagcgctaggagcggcaccatagccatgccgcggcagactcagactcacctgggcatcgaccaggacgacgagcttcattggcgctatctttccaccacagacgcgtacacctcagaatactcctcggcagcctcggatggcgacctcggactggaagtgccccaagccgcaataacgatcgatgctgccgctggtccgcaggcaatgtaccttcagaaacagcgcgggatagtcaccaggccgctcctggtcccttctcagtcctcgagcgcggtccaacaggcagcctcggcgacctctccagtcgtctccggccttctttcatcatcgcagggtgaggccgatgacagcaccgatacgattaaaagcatgcgggcgcgtgcgctagacaggatcaacggccggaaaggctctaattcaaacacgaatagcagttacaacgcaaacaccagcagttctagtcccaagagaggcacagttacagccacgccagccactcaccaaggccttgcacactctccaggtcggagcacagttggacaggatatcaacccaggacagggacatggcctcgtcagcagcagtaaactcaagaggagatcatttgggcatacaacagaccgcgcctcagcccctagagtcaacacgaggatctcctatccagaagcgcatcacaccatcccgtctaccgcacccatccatgctcgaaaacgtacctctggctcgttcaagagccagcagatcttgtcgacatcagaggacgagtcagagacggcctacagtaacacaaacgacagagctcgatacgttaatgacgatacttcggtcatgctcagcgagctcaaggccttgaagacacgagttcaggaactagaaatggagcgaatgaaccgctcactctccggcctctctgcccaaagctcctttatcgcgtcaaacgacaaccctgggcgcccagtactcgaagggccgtcgccgccaaattacgccgagaagcagcatcaaatcacccacagacatcgaggctcagccgcctctgctgagtccgcgagcactttgggctctcccccccactcccaatcccaggcatcgatcaccagggcaaagtcaatcgcggcacttcgcggatcggtgtcgtcgacaggaataaatggacgcgtggaatcgtctgcgggcaccgcgagtctctcgcgatctgtgtctacacccgcggtacagcagccatcgacacagcatgtggcactgctccaggaagcgttcaaaacctttgaaaaagccatggcggtaggcggcacccgcaggggaccctcagtccaggctatgagcaaagtggtcttgaacaccatcagcatcaaccaaactctccgcaccttgatcaaggccgatgtcacccttgtcgactcgccttcgatgtccacattacaacggtctagtaatgagcagatccggagcttgacagagtccctactcgctcttgccaccacgcaaacgtccgcgccatcggaactggcagactattctcccatccattcttccggatctttcaagacgtattctggacaactctcatcattgggaatggtggcgaacgagatgcgcggtcgagcaggattggaaacacatcaccccacacgacctttatcgtctctagcatcgtctctagcatcgtctcagatagagtctggatcagcaacgcccaatgccatgtcgtcctcaggatatctgaccaggacagactcgatcgcatcgagcactgcccctcgagtcgcaggtagacgtacgggctacgcatcggatttcagtcaagaccgacacatctcgtacggtggcattggaggcacagggtacgcgcattcagcaaccgcctcaagtcgagagtcctcacctccccaagagcccgcccaagagctgttcttgcgtcgtcagatgcacgtgccgggcttgaggagcaccgacagtctcatagagtcaccgcgatcgctccagtcaccacagctccaagagcagcgctctgttacagctgctgttggcgtggaggcagggccaggcgatgtttctgcccatcgtgcaaggcgccaggcaagtgtacgaaacatcatggcccgatactctcatctaaagtccaatacgcctacgcaagaacgatttgatcaggaacaggaatcgactgcgggtcgtctggaacgccatggactcggacaggaatatgctaggaacagattgtccaaccatgccgacgtctccgattcttcatcattccatattcgacaacagccacagccagaattgcaacatttacaacagccgcagcaggcgcaacgagagtggcatcgacctgtacagcgccttttagaggaccctatggtggcatccgtcgacttttcgtccgccggccaaccaacgaggctctcgagcagccatcggagacctctttctcagcaggagcagcggagctattctgacctcaggcaggctggagcctcactgattcgacagggaggtgttgttcaaagatcgggaagatatgcgcatgacaaggtcttttccgaggacgaaagcagcagcggcggcggctgggggaccatgggcgtgatggagtctctgccgccaaagtcggcgccgatgtccacgtttgcagaacgtcttcagggattccgtggccgtcatcaggagcagcggcagtccctccaacagcaattgcaacggccatttggcttggatgagcgactctctcaaggttatgtccatgatcagctgcaggagctgcaggagcaggatcaggagcaggagcaggatctgcagcagcgccgtgagaggcacatttatgcagagaccactgatagtgacatggcggacgatgctcctgttccgcattttgctcaacgtcgagcgcagccccctcacaccctgacaaggcaacaacagcagcagcaacaacagccacagctacagcaggcgatcgatcaatcctatcaaaagtaccctctacagcggccgccctctcagcgccaccaggacatgcagatgacaacgccttcgatgccctcgcccaattcatcgccgtcctcttcatcccgactagacgcaccctcactggtgtcgagcatcggtcaccacgcgggtctggtgaacggggccggctcagggatggaggggcgacttcatgtctcgccacgagggatctcgtctggtgccgcccgattccagcaaccatagacggctggggatggatcactgatatcacccaccttttcgcttcactgtctctctcgctgtccctcgctctttgtcaccttcagactccctcctcttcactcttgcctcccattgtatccatccatctgtccctctgtagccatttgcatctaataaaataacgtgtgtagctttgtaatgttttttttatggttttctgcaaaaatctgcttctgtagtttttttttttttttttgactactcgatgtacaccatacatccttcaccatattcttcaaactcgtcctccaagccagagctgctcttgaccttcttctgcccagccgattccggaagtcgattgcccctataatggtgataacaacgttctcgctcctgttccgcatgcgacatggtcggaatcttttgcatccgatagatcttactccgttgactcggggaccgcgacggcgacgagtaaccggaaccagagtaggttgaatccgtcggagatggtgagcgcggacggtggtgtgctgctgctgctgtgggtgtggtggctgttgctttggctgtggctgtggctgctgctgtggctgaatggtacgaatgttgcatctgcatttcgtagtcgtgataagtgagcggagacgtcgggctggtcggcacagcggatctaggcgactgcgtcgactttcgcgcattgactgtaatctccacacccctccgcgatggctgagcgtgcaccggcagaggacggggtacaggtggcgaggagtgatattgtgggttggagcgaagcacctgaggaatactgtgctggttggagtaactcctgtgggaagaatattgcggtggctgatgctgatgctgctgctgctgatgatggctatagactgcgcgatgctgaaccagaggcgtggtagggtatccgccactgctgctgtccatagactgcacttccgtttcatagcgctccaggggcaaattatccgcctcagagcctgcaaaggacggaataggtatggtatcgctcgtgtcatcggtcctaacatggcgctgatgatgatatccgggtgatgactgctgagagcgccgctgatggctaagctgctttggggacgcaaacgacggtggtgctggtggcaagggtaatgtcgagaacggacgctggttcggccaggacacgggccgttgtggcgtggtagactgctgcagtaaccgtgaccgtaaactgtcgtcatacacgatcggcctcatcgaaggctgttggggccgtggtgttccaggtgcctgggagttggcgggcgcagcaacctgtgacgaccattcgcagccccgttcctccgcaagaacgttctccagcttgcgcttcaaggctcccttgaacaatccactggtcataccccggtccggcggcgtcatgggatcctggccgccagcggcctgcccgagaggcagtcccattgcttgtcggagcatggccccttgcgctttcgcaaacgccccgcgtcccgcgctcggcgactttaacagagccaccgcatcgtctgctccttccttgtccgattcgtttgtctcgtcaagcttaaaatcatccgccgggggatcctctgatgcctccggcccatccgtcagactgatggcgagctcaatttgcggtacagggtcggtgatttgagaggtatgcatcgaaatcatcccggagcattccaggaaccgctcatccggctgagtggcatccgtgtcggccaaactcaggccctggctctcggatgccgttcccatgtccgaatacggcagccgcagtcgatcgtgaaatactggcttctttcgtagtctatggtgcctgttgagtacagatgtgtccccactcatcctggcagacctgggtgcatcgtcagcagtggacggaacggacggcatttggacgaggcgatcatcgttctcggcatctgctgcatccgctgcatcttgttcatcagcctctgtgacatcgagtcgcgacatctcggacgagagttgatcgtcgaaatcatccgcatcgccagcttgatctcctactgtctcttgaacgactttgaggtcaccttgtgtagcacactggatctctgctattttcgcgactggttctaccgtccttttcctgaccactgttctgatggcttcagcattctgcggtggcgtgtctcgtacacctgctggtaatactgatttcgaatagcgttccctgcgattttggatctcggaatgggccgcagtggacgttgaggtcgtttgaacagtgtccagagtcggctcagcatgctgtccacccactccggcgagtggcggcgagccattctcgccaggcgtctgtcctgttcccttggcttctgcaactgtgtgagccgatgccgcctttggcttccgctgtaacgccatcagtaacttgtccaactgcgcaaacttggaagagtcgtgggcatatctccggtgctccggtgtggcggtatgctattaaagtcaagaaagaaggtgcaaagcagttcacattagatacggtcggtttgaaaagtcatttccacactatgctgagcagagacgatgctgccaacatcaacacgtactgcattaaaatcatcataaagctgccggcagttttcgcagtatcctttgttgcggtagtccttgggtgctgcggcctgcgtggcactctcctcggcctgcctctcctttggttgctgcgcatccaaggccgtagcggactgcttgtcctgcataggctccgctggtggttgcttagactcttcaggagcgaccgtattcagatcaatggctcctaaaggttgcctcttgagtagattcgaatccgtgtctgtcgtcgtcctgcttgccctgacaatgcttcctggatgcacgaattcggatgtcttcaccgctgatgggacaccggcttcacctttggtggcgttcaaaactcgctttccgagctgatcaagtgtattttgcaatccctggacggcgaccggtttgctcatggccgatgttgtcgagattgcattggaggtgacagaattgatgattcctgacgcgggcacggagggcatcattcgcgtatcgcaagctgctgtgttggattccgctgggatctcttggcctttttgaacctcctctgcatccttgatagtctcatccttgtcattgacaatctcatccggcttcttggtgctctttgaacggtcatgagcaaacacgaacggacttctgttggagtgcgactgtacatatagccttggccacggggtgccgccgtactttggtacctcttttggaaactcttgtgcgattatagtgcgataatggcccgatacatcctcaacgaggaggtagtgatccttgagcacgtggtactctgctcgcggagagtcgtcgttttgcgttgtggtgagtccatagaccttttcgtgctgaagaaagtcctgcaagtttcgattttcgagctgttgaccggttttagcgatccttcctcccaccagtggattgatgaggttgaccatccgctcgagactccatattttgatcccgtggctgagcgccttgacgagaatgttggactctggatttgagttgggtggtagcgccaaggggtttatggggagctttccgggcacaaaaggcgacggaatcggggtggtgggtcgttgcagcggcgtttgttgactaggggtcttagacctgggtatatagtttgtagtgacgatgtgggtcacatcaagcgagaagaacatagtaacgtgctaatcgtgtacatgtcaaaagtagaccgggttagagagggttatgaagaacgaccaaccatcctcaaaggtaaaagacgagtgtcatgatcttcatccgtacagcgtgatagtggtgcagagccttcgttagcctagcagccatagactgatcgacacaatcgaaataaaatttgcatcgaggcaaaatccgaacaagattatcgatccattcctttgagccatattctggagctgaggcctgtatctgaagcggatcctgagcggcggcgtcgtctttgacaggagcttccggcgcctgcgcatcgactgtggtgctagtcttgagggtatgcgacggaaccgagtgcttgacgttatgctgcgagtaagaagattggctttgaacaacagtatcaccccgagcaggatacgatggagcggcgctcctagctccatagtgagcattatgatgaggggatgcttgagtgtatttcgcttctcgagtcggatatgacaatgtcgagtgtttcgatgccgaaggcgcgagagacggagccaggactgttggcttgggcttgtaggtggtgatggatagaggttgaagggctctaatgtttgcagtgctcgagttgaggggcttctgctgcaacgcgatcctgggacgcaccatgtccctttcttcggcaacagtggcgttcatggagggtcccctgcgagcaaacggtgcgacaaacatgggcttaatcacgttgccatccgacgcgaacttgttggctgcattttgattggtgatgttggaaagactctgccgccgatgggtgttgatgttctggccgtggctctcctgcagcggcatccgcatggaagccgcgttggcgcgatccgtcatgtccagtgcttgtgcgcgtggtcgaggtttgtccgctggatacgtctgctgtgtgtcgcgatggggtctctggctggtggtcctcagggcgatgacatgacagcctggggtgctgtgcgagtgggagcagacgggtggcagacagaaaaaagcgcacaggcgaacaggcgaacaggcgaaggaagcacaagcgacagtagacgggcgggttggagatggagtgaatgaaagcgtgtatgtctgtgtgcgataaaaaaaaataatagcagtgcacgtgatccagcacgtgcactcacgctcattaaaggttgaatgcggtgtcgcattcaccatgaattcaagctcgttttttcttccctttgcctcgccccccctttttttcccttcttcttttcttctttgcatcgttcaaactctctctttctctctctctctctctctctctcgtccctcctttgtctttcgcctccatccatccttccacgcggactgcagctcagggccctccccgccttcgcacgttcgctgcattcgactgcccctcgaggcgccatcagactccgctgcccaccccctctcgctcgacctatcgcccgcgccctttcgccccatagctgctccaaaaggtaatgctccctttgcagcctcatctcttgccaccacactctgacccgccaatggctgtctgattgaaacattgctttcctcggtgtcgcttccaccatagcttgccagccacaccgtaccggactcggcaggagagacctggaagaaaaaaataaaaaacgaggtgccatggtcgccacggttgtttcgcctggggcgatcccagagtttgtacacccgcccgtgccaggcgagtgccacgacttttacggggacacccacctggactccatcaaactgccagcttcggcctctgcagagggcactagcaactctgcacacgcacagcgcaggcagcacgcagatcgacaccgcccccacgataacggcagcctaacagacgcttcgtggacacacgaggctggcacagctgcagctccaagcacagactctttacacagtcctgtgataggaaccataacagcaacagacgccgatcagatagagagctcctcggacgatgtcgcttgggctcgcttcgtcgaggcctgcattcatggagaggcggagaaggtacaggatatcctcctggactcgccgcagctcaaggattccatcgataacatttcttcagcaactggcatgaacccccttcatttcgccgcatcccgtggacacgaggacgtcgtaaggatattgatcgacgcagcaggcgcaggagttgatgtgtcggatcgagaaggcgaggtaaaagatgctatcttcaggctgtgtggtgccatcaagcccctcggcatctggccatgagcccggagagcctttcagtgctgtgaccacctcttgaaaatcatcatcgttgctcatcatttctcatcaattcgcgtcttttctcacactgtgtattagaccgcacttttgaaagcgtcccatgtcggctgcctccccgttgtatcctttctactgaagcgaggggccaatgtgcatcaaagggacaaggatggctggactgccctgcataacgccagttctaaaggatacattggcattgcacaagtcctgcttgaaaagggcgaggcagacatcaatgctaggagcaaactggatcacaccccgctaagtatgggcagatatgcatgtgcgcctagacatggttcaaggattcgatagttgcgattctaacatctcggttgatcttgtcttaaaatagtcaacgctgcctccaagggcgacatatccatggtgctctactttttgaatcacgccaatgcggatccgcttctcaaaaacaagttttcagaaatggcgtacgatgtcgccgccgccaatagtgaggcatatctttgtgatattcttcagaccagcgaaaagcaatggtggaaacgtacgtgtagcagtataaggctgctggccagtgcttaaatatgagcgcggttgttgattttttagctgacgtcttccactcaacgtgtaaatgcttcttaggtgaccacactgcagatcaagtgtatgatcctctggttatacacactacggttctcatgactatccacgagaaccaaagggctgcaggatcatttccactgtcgcttatggcccccaaattctctgccagtgcactcacacagcaggacgtctgcgggccttggtcccttcctaatgggcgaccattcacaaaggacgacgttcatctaccgctcgtacccgttttagggccttcaacctccaggaacaacatgcagcggggatggttttggcttacagagtggatcgtcgataaaacggatccaaatattgacagtgaaggatggcagtacgcaaagtcgttaactgaggccaatcagcaatggtcagcaaccgtgccaacctcagggagcagttgggtccgccgtagaaagtggatcagggtgatgaagaagcgagtggacctcgcaactccatccgaggaatttttgaaagagtctgatgaagcgatggtccagcagcaagcaggaaactacatgaagcgagctagtcttgccctgagacttgatgacggattttcggacagcgcagaggaacttgctcggtaccgtcaagctattcagatgctactccagggcatcaagagtatgtgcacgaattctcgatggaaacgcggttgtcgtatgttttcatgaaaatttaaccatctcatcgtaattgttctttcacgcgtcaaacagtggataaggattcagtattgaagctaaaggccacagggatcgtgcaagagtaccttcagcacgccgaggaactgacgacgctcatacgagaacgagaagctgcagcgagcgggatcatcagccagctagatactccccggatagcacagcgcacagcagagggcagtcctggatccagcactgagctgcgtagtctgacattgcagaagtcaagaccgtcggacatggatatcatggaagcgcttcctattcatcttgggcatgctgaggatgatggtactaccgaggaaagcagcgaagaaagtcttgacagcgttagtaacagtgtggagtctcaagatgaaggaacagatcaagtctatgagaccgcgagcgaagggcaggagtcgcagcaacagccgatttccgccgaggagcagccaccatcagcaggtgttttcacctccctggaggccattcataacgatgcttcatcgtcggatgtcgtccttggcacacctgatctcatgatcgctccggaagcaccactcttgaacactgaagtccgagctgatgaggcctctgtagacacagaggaattcctgagcgatggcgctgttcacgttcgacagtcctcagccagtatacccattttaatatcgcgccaagagcctccagaagtcactgttatcagcccttcacccgctgcagctccaagtgagccatttccgatggcgcgactgacgaggagcccaaggtctagcacaccgacatcgttctcgagtaggcctaatatccaggcctcagaggaactatcctcatcgcccacagccctaggatctcagtctgagacgcgccctctctcgtcgcataaccattctggttctggatcggcccagagctcagctgcattttcctctggactatcccgagcacaagatacaccgcctagcgcacgcggcggggtttcggaatcgatgcggcagtcgtcctcaagccctgcagggtcaaatcaccacttgaaccaggacagaaggacgtcttccatgcaaactcatcatcatcgacagccccaagcccagcaacattaccactctccgcctccagtatctgaagccaggtgggagctggattccaaggccattgagtgcagagagtgccaccgaaagttttcactcttcctaaggaggcatcactgccgtcgctgtggccatgtcgtatgtgacaaatgctcgagtcatcgtgcgacgctacacccctcgatggtcgtgtatgacccttcctccaatgaggcgtttatcaaccaccaaactctgagtaggagagggacacttcaaagttaccgcgtgtgtgactcttgccacgaatccttgggacccactcgtcctttaaatatgggctcgggctcgggatctgcttcgggctcaggcacaggagctggatcgcagctgcagtatcatagatcttaccatgggcagtcctcgccacaccatgcgggtggccgccattacccgagttctacagcagggggctttgttccgacagatgggagtatgggtgtctatctacccagtgcaggatatggacagaatcaaagatcacactcctcgtcaaggagctcgagttcgtcgaatctgcatccgacacccatggtgcgcaatgccagctcaagctcactgatgagcgagtgtccagtctgcggcgctgttctggctggtttagagggcggcaaggctgcgcaggaggcacatgtgcaagattgtctggaaggcaagccgggtcagggcagcggtcctatcaacaatgtgcgctatattggtaaggactacctcggcgagacacctctgcgttgatgttttggctattgctgtattgccgttgaaagagactaacgatgttgatactgaactgccttacagtctacaagttgccagctgactcgcccttgatcgatcaggaatgcgcgatctgctttgaagagtttgttgcaggtaagagtggaaggcttgcagcagcggtgttatagcaggttgaaggagagaagagatggatgcttgtagtaaccgttagggccttttgtcctgtttttctggataggacgaacggtggccagactgaactgcctgtgcacctatcaccggcactgcatccacgactggctccagcatggaacagggtgccctgtgcactatcgttgagcactaccgcagagtctagagcctagagacggtgttgacaaaaaaaaaaaaaaaaaaaagatgaacgggtcgccaaaatcgtgtctttgatgccatgtgccttactacgatttaacaaaaaaaacttcatctacactgtgtgcgacaaggagtgcgcctgagcgatcagtgatgagattcataagaacgtctatacttgagttcgaggaaccctttgtcttccttgatatatgcctctcattcgatttacctttccctcccttttttttccttctatgcagcagaaggctgttacagtaccgggtcccagaagagtctaaaaatgccaaacgcttttatagtaggcgaaaactgtaaaacggctaaacgtgaactaagtttgccgatttgaaaaaaagaaaaaaagaaaaaattgcatcttttcgactctggcgttgtgcgcaacgccaaaggggaggagcgcacttgagttcgctgtagtcgcggtcatcatggccagcctggtcaaggagaggaaaacgcttagcagatcatgaagtgaaaatgcaatcgaaagaggatttgagagtgcaagggagcagcatgtgcccctcgagacacttgcgatgtctgctcgcccgttttggcggtgacctctggccaggtaccgaaggactgacgaaaagcccgaggcctcctggttcgtccaggcggtgtacgtgcagatgtacgtgagtgagaggtttgtttatttgctctttcccgctttcgtctcccttttcttgcgggtgttctcttttcgcttgttctctctctcttctcatcatcatctcatctcccatctccactctcacaacacaaccatgtctcacctcacccacggccaggaaatcgagtacaaggaggctttcgccctcttcgaccccaccaactcgggcaccatccagcccaaggccattgccgactttctcgctgttagtacccctcaccctgtcaccctcctcccatcgcactcgtccttgttcatcatcgacccacccactcctcagtgcaccccatcactgcgctgattcgcttggtctcactctcggtgtgttttgtggcagttcacttggtcccaatctgaacaaaccagcgtgcctctgtccgcaccccgcactttctgctccttcatctctctgccttgtcatcgctcgagtttcccaatcgaccatctgctcgtcacaactcttcagtgagtgcatcagcggtgcatatttcattttaccttcagaggacgactgtgtctgtgcctgtgcctgaactgcagaaacccgtctgcctcaacgaggatgatggacaaggacgacgtcgtgtgagcttgtgctctttcttttttttttttttttgctcttgctcttgttctgcctgtcatggctatttttgttcagaagtgtgcctggagacttgtgtatgcttcaccctgtaatgattgttatccaactgtgggcgggacggggcggatctgacaggtcttttgaaaaatgaatccaacaacatgaaagcacgtttttctgtgcgacgttgtctccccgcccatggcgtgcagtcttacctgtcatcgcccccttttttttattttcggcctgacaagccatggtgttgcggtgtcgtgcacttgtccctgttcctggaattctttcctcttaggcccattttgtatatgttgtcggatacctctttttccgcaaccataggagttctgtatcctacggaaaactcttttttgtcgtcgtcgtcgtcgtcgtctccgtgtattgcacctctctctctctgttagagactaagacaccttactcatccctctctctctgtctttgatcatgttctactctactgatttgcaatccagctcctcaacgaccccgagttgaccaagaacgtcaagctccccacccagcccttggacttcaaggcctttgccgccttgatggccaagaaccacaagggagccgagacctccgatgaggcctacggtgctctgttcaacaacatcaacaaggacggctccggcaacgtttcctctgccgagctccgcgctgccctccagcactttggcgacagctccctctctgaggtaagtggctttatttatggccagccttcgtaaaatgacgatccgatggcatcttgaagccagtggagtggacggccgacctggacgaaaaacagacgtgaactgactcgagttttgtacttgacctctaggctgatgtcgatgagattatccacgaggccgatgtctctggcgatggccgtatcaccctcgaggagttcttgaagatcatgcaaaagtccgagaagaagctccgtggcgagcacgttctgtaaaggatcccactgtctgttcaccatcctcatctaagcacgtaaatcctttttttattttcgtcgtcttgggtccccgcctcctcatcctctcacgtctttttgccaaataaactctcgcgcctcaagcagatcgaaaaacagcaagtgttaatatgcatgtgcacaaaaagtctgtatgcctgttgtgtgtgtggtggcaaagcaataggtataaagactttgcctctgaggcgaaaaatggtggcgtggcagcagcagtatggatttctgcctacaaaagaacagcgcatgcctctgggagtggcgcgtctcttttgtctcctcatcattccttgtccttgaagttgtcctttattcgttcttccgcctgcactgttgctccctcttcaagctccattcctctcctcatcacctgttcctgtcgttccttcggacagcacctcgccgctgtcattgcccgttcatttgcaaacactgcataccccaagagtgcttccatagtcgaaacaaaaagccaattagacattccaccaggcaagctacaggacctgttcaaacgcaacccagacccagcactttgcttaaagaaaaccatggcagacacggaccttgtcagcaacaagctggccatctatcgccagctcattggccagaacgtgcccttgctcgagtggcggtacgagcaacgtcgagaaatgcaagagatcctcccgtccatctttctggggccttactcctccacgcgcaatctcgaagagctcaagaacgcaggcatcacccacatcgtctctctctgggactcgtcggaatccaagattctcaaggtccatcaccccgaccagtttcggtacctgcaattggaaatctcggacgccgcaactcagaatctcattaccttgtttccggccgtgaaacggtttatggaccaggcgattttgcaggagaacggcaaggtgctagtcaactgcatgagcggcatttccagatcacccgcgtttgtggtcgcgtatttgatggaggcgacaggactggattacgaaatggtctatcgatatgtccagaacaagcgcttctgtatgaacccgaaccctggattcaggcatcaactcgaggtaagggtttatccaaccatttgctggatgttgattgttggacagacaaaatgtatctcttgatcctaatattctcttcatctcttcgtctgcttgtgcgcgatccgcgcgtcgtaggaatacggaccaatttatacagcaatacagtcggtgggatcccagccaactgagcagcggtcctcggttcgaagggcggcccccgaggacgacgacgataatgctgaggaagcgtacgtgaacaagagattcttcttttcttctgatgatgttgttgtgggcccgagaacgtatttctaacagttgttctcgatacttctgaacattcaactcgagacagtgaacgactcgcaccgcggttacggccttgatcgaatatcgtggagacatgacgaggtctgcaaaggatcacgttcactggatgtttcactgttcctcggcttacccgcgatctcgccatccatttgccataccacgacccttctcgaaccctctcaagtgtacgcacaccatcactcacccagcagcgaccactcatttgtacaatagaacttcagtaatgaaaagacagtcggttcctgctcatcgccctgctattttttttctttttgtcacgacaacaattggcgggaaaagacaactatgcggaacagctcgcccttttctttcttttttttactgctcatgaaggtcagagatgtctggaaaaaaaaacgatagctacagctcatcctttccgttgatcctaacgagctctacttcaaaattgagggccgagttggcgggaatggcgcttcccatggagcgaccaccatatcccaagtgagcggggatcgtgagctttctcttttcaccaacgcacatcttctccaagccctgatcccatcccttgatgacctgaccagcgcctatggaagaaatcaattgaatgtcaacgtgcgttaatttttcaccttcttggtgttcagcaagcaaacgacggacaagaggcacaaaaaagagaaaaacgttaccaagagtaaagtcgaaggtacgtccacgatccaagctcgaatcaaacttggcaccagtcttgtgaagggtaccggtgtagtgcatcgacaacttgtcactaatggatgtcatgtacaatggatatgatagggtcagctgtcgatgttcttggtctacaacagactactgctgtggtttccttgtcaaggcaggttcagttccccactcgctaaaagacgtacccggacttggagaaggtggtgcagccctcgggtttggagaggacatctacatgggatgacagaggttcacaagagcaaaatatccgttagtcagtgtgattcaagtctaacggatgataatgacaggcaaggatcggaggatccgcacgtcaagtatggaactgaatcgttctccagagtcttgtttctgtaggtatgaatgggacaaaaaggagggtgcaccttgggcatgcgctagtttggaacagccctggatcgtcccatattaccgataacgagttcctggggagcgtcataagccatgacctgggccgcgaggaggatggcaccggcagcgagggcagcaaaagtcttcatggtgatggaggggggaggttggggtgtgggtgtgggtgtgatgggaatgtgaatgtggatgatgagaacaaggaatcgagaatacagcgacaacaaggaaaatatagtgcgaagggaacacccacgattcgacggtcgcacacactcgcacatcacacacgctgccagaccgttttttgcttcgcatgcagccaatgaacgatgtccaccgaagggggggagtggagtgagagaacctttttcttttcgtttactgcacaacgcttttttttagtgtcccccttcaggaccacaccacagagatagcagcaagagggacgttgcgcatgctgcaactgcacgcgcacgcgctcagctccaagtggacgattccccaaacgaccgatataatcgtcatgagccgttcggtgcttaaagtgatcaccatttttcatttccactactgccgcgcctcttttcttcgtccatctccccccgccctcatatccgcataatagcaaaaaaaaaagcagccatgaggatcatcaactctgcggtcgtactgaccgtatgtgtcgctctcgtttgtgcgcaggagcagcagcagcagcaagatcaacagcaacaacagcaaaccgcgccagaaaccccaactgcatccgacaagtatcaggatgatccaacacaatatggccctcccaacgacatgacccctgaacagatcgacctggcgaaacacggcatcgcgcaaatcttggccaaattgcccgttcagcagctcgaccctctggtcaccagtatggatggctactgcaccgcctttggcgcactctgtgctgctgcttgcaaagaacgcgtaacgccagagaacaagggtgacgaatctgctgtagctcaggggtgtcagaatccagccggtgcgacactgggcgaagtcgctgcctcctgtaagtgtgcctccatggacctgacggaacgcgtcaactttgcagtgtaagttctcgtctcctactcgctacgccaactagcagagctaaaaatcggcaaaggaaaaaggcactgacccatgtattttttttttctttttggataaacatgcagtgctggtgggttcatgtccagccaaaacgctcaaaagggtgattttgcatccgagggcattctcgacatcttgaccttcattcctgcggtaccagggttcctgagtgtcattcacgtccttcagaacatttgctactacgtcagcttcttggacgtgctcgcctccaacccacaccccaactcgagctgtcctgtcagccccaacggacctcttggcatcgtcagctccatcccggttcttggacctcttctcagtggactcctaggcggtctcgtgaagggtgctcccacgccggcgccattgccaggcccctttgactggttgttccctcccaaaaagacccctactaccagtcccacacccactccatccccttcgcatgtcccttcgatctttgaagtcattggcgatcttttcaaacccaagcctgtagctaccaccaccacctctgttaaactcacaaccgtaacgcccacacataccccgatcacgacacccaaggtggctgctgcgggcaatttcatgagtaccctcgtggacgatatcgaacaagggatcaaaaacctcatccctgcctcgtctgaaaatgatgagaatgtcagaggtatggaggccgacaagaaagagtgggcgtcggaggacgtgtccaaaactaaaaaggtcaaagcgaagcatcatgacagtcgcgtctccagaagtgctcgagctcagagacgccatattgagaaggcggccaaggaccaggacaggaatgacctttgagaattgaaatgcacactgggcggtctccaagttttctttgtcttatttcgttgtcaacacgacacacacacaagacagacagtactagacgtatatacccgggaaatgatcaacgagcccgtcataaaaaatgaagaagtaagctggtcgtggtcagggccttccactagtagccgtggagaaatctacgattgtgtcaaaaactttttgaatcgacgcgatatgaaaatactttattgatgaaacagtgcaatagcgcaatgggacgtggtgaaaatagaacagcggggagcaccacaacgcgatcagtttgggcatgttgctccttcgattttttttttttttagttttcaggtcgctccgggcagccaccccttctcaagtaacatggagcagagttactgcagtccctcgagaaacgacaccttacgtcaggctgtatccagcaccagccgccaccctcgcagtctttccaacaatcttcacggtaaaagaatgagccacaatgctggtcccccgcgtcggcgtgttgtatcttgcaacagagaataatgacggcaaagagcaggaagacgtgtttgttgacagaaaacatggctggacctgaggtcgcaaagaagttcaaatctgactttagcgtcatgttcaagtgtgccaaataacagcttggacctttgtcgatctacaacacttactgtacttggaattgaaaaaatcaagtctacaatgggggttgggagcgtcttggagtgcaggaaggatgttttgcagaaggaacgtgagtgggaagttgcgatgtctgcaaaggtgcaagcatcatttatatggaagcagtcaggaagaccggcagtgtgagtagcaaccgcttttgtttgccccttgtcgagtgaaaagagattatgcagaccatcgccctcttgtttcctgacctgtcttggatctaactagcctcccaccttttctcatcttgcctttgtttcgttttgaagccaaagtagccccaatggaaggatttacaggaaggatgcaaaatagtgcagaccagccaggatgaccggcagtctgatacagattgtgtttgattcaattaccattccatagccttgccgtagctcagctcgacatcatgaccataccactatatgaccccggtgttgaacatggcggttcacccgctttaatgtatcacttgaaagcctcgccatgaccccgcttaacaccgcgcttgttgccgagcatgacatccatatcaagcctgccaccagaaattgcagcaatgcccgctttgcgataccactccatggctatatctaggtcctcctcaacatgaagaccattctcgtacataaccgcaatgtcaaacatggctgcagaatttccagcatcacttgctttgaggtaccactccatagccttgtggtagttccgctcgacaccacgaccataccaatacatgagggcgatattgaacatggcatcgtcatcgccagcatcgcttgccttgagatgcaaatccatcacctggccggagtactcctcgaaaacttgaccgttacagtacgcggcattgatgaggcgcaaggcctgcgtgttaccagcgtcacttgctttgatataccacttcatagccttttcagagtcctgttcggtgccatgacctttttcgtacatgagggcgatatgtagcatggcatcgctatttccagactcgcttgccttaaggtaccagtccatagcctggtcgtacccttgctctacaccttgacccgtctcgtacatgcctccgatggcaagcatggcaatatcacttccagcgtcgcttgctttgaagtaccattccatagccttgccgtagtcctgttcaacaccctcgccatactggaacatgtatgcgatataaaccatgctaagggcatttccagcatcgcttgccttgatatggcactccatagccttgccgtagtctttctcaacaccgtcaccgtcgtgatagatctggccagccattaccataccatgggcatgtccagcgtcgcatgctttgaggtaccactctatagccttggaacagtcttgctctacaccttgacccttgttgtacatgatcccgatgttaaacatggccagcgcatatccagcgtcgctggctttgataaaccactccatagtcttgccatgattctgctctacacctttaccctcgtcatacatgagtccaacgttgaacatggcgtaggcgctcccagcatcgcatgctttcaggaaccactccatcgccttgccgtagtcctgctcaagatcatcacccatgcagtacatcgatgcgccgatgagcatagccttgacatttccagcgttgcttgctatgagaaaccaatgcatagattggttgatgtccttctcaacaccttcaccaccgtagtacatgctgccaacgctcagcatggcttcagagttcccagcctcgcttgctttcaggaactgctccatagccttgttgtagtcctgctcagtaccttcaccacgccggtacatgactccggcgttgtacatgccagtaacgctcccagcgtcgctggctttgagataccattccatcgctttgccaaaatcctgttcgaggtctccgccatgatagtagatgtcgccaatgctgagtttggcggctgtggccgcgccgcgctcggtgttgttgaaccactccatcgtctctctgtgatgttcgaaagccccagttttgtggtgaattatgcagttgttcagcctttcttgctcgttcaatgtctcctctgcttttcgataccaccatgttgacttgtccacatcctgctccgcgccacaacctgaccgatacatctgactaaccttgagcattgctacagctataccagcctcgcttgcagcaaggtaccactccagggcgtcgccatagttttgctccactcctaggccgtcatagtacatgctacccatcgtgaacatggcctttgctgacttattgccgacggaggagatatcaaaccagttcattgtcgtttgcctctccggaagcatgccgctctgctcgaggatttccataaacccagggttctccttgctcttgaaatactttctcaaagccttaaaataatattctttttcgccctggttcctcacagtcctcgactcttgtacgtcgttcatttgcgatgaagacctggcatgcggaagcacctccacggcagtgggcctctccttgggtgctagcttccagcacatttgaaggcaggacgcgtaggccatcggcgtgtggtccggatattcctcgagaatgccgttctcgatgcaatagatctttccatcgggtgtgtgctctcggtagggccgcgtggactcggccgccatctcccacatgaccattcccaaggcatatatatctgatttggttgtgtactttggcggactctgaagcaactctggcgccatccaatcaagggtaccccctcctccaccctcaccagctctcatcgcaactccaaagtcgcatatcttggcctccttgtgctgagtgaggagaatgttggagctcttaatgtcgcagtggatgatacccagggaatgaagatgggcaagcccgagggagatatctttggcgatttgtgtcttgacttcccaggtctggagacccttctctactatcgcatctgctaggctacctccttcgacgtactccatgacaatcatgtcatgatgaacatggtaaaactggacaatgtgtacgtgagtgagatccttgatgatctcgatctcttgctttgtgctcctgtgtgtcgaatccagaaacctcttgaccaccacatcatcgagtccacacttggccttgaagatttctgcctgagcaccaccgccaatcttgtttttcagctcaaggatgtctgtctggaggagaagagagagagaacgttcgtgaggaagcggttgcatattttatcaactttcaatttgtgtcgttggtggatgctgtctatggcttcatcttaccctgtagttgagagaccaggagaacatggtgactgtagaataaaggaagaatttctgacaatggtggagcgaaagatgatgtgggggatgtgagtgttttgaaaaagtggaagaagagaggacagcgtggggtggcgatgtgcaagtcaaggcaatcaacttcgccatccattcttgtgtaaattgatgtgcatgatttggtcaggggtactgcaaagtagactgaacgcccttgtagcagtgcaatgtcgcatgtttaagtgggcagtgcatttcttgaacatctgctgtcaccggttttcatcgcttgaccagccaagcagttcacgcgtgcatatcgctctaaaccccgtactgtttcaagatttgaaaaccctatttctcgcgtattcctgtacaactgctccctgtctcgttcttcccatggcttaaattggaaatggagtcgcatgggtcaaggctgactgtcttgatgaaatatacgtgtcgatcgcctccttgtttccggttgccctggctcacggcgcgttgatatcctgtccagctctgttccatccatctggccccgtcaatttttatactattctttcgaaatcttcccatccatcctagaagctcgttcatctatgctactcaacacgtttttgttttttgaacaccaaaactgtagtcatatcccaggcagacagcccacgacaatgtttttagcatggccccaagcagagtcagagcccgatgtcctgttccaagaacaaactgcttaacatagtaccgtagattcgaacaaaaaaaaaaaaggtgctgggatgaaatgggttctattgtggacgtacttttttttagttgctacttcacttctttatggtccagccaaaggctcggtacacgcgagctgaaatatcttttgtgtcctttttttttctttttctctggctgtttgcttctatcttgtttaggcatggttctcttccggaatcgcctcgaatttttcacgagacatcttcaatggagctggagggttggtattgacgcgaatactcaaggacaatcggcttgtcttgtcgctcggggggactaccagtggagcaagacagaaaaaagagtggccaaacgcaagatttagcccagttccaggccgttaccatgttatatattggtcaaagtacctcttgggtcctgcacaccttttttttctctctctgttttttccccatccggcgaacactgaagttgcccttctggtcgacactttgttgttgactttgatctctttttttttgttcattgactgcgtacttctcgcaccctatgaactcatagtgcttgtcatacctcaccccaactttcgccccaacccttggccggcccaccgttcgcgtcctctgaacgcaaatgacattagcacctggcctacactcatagactcgactcctaaagaccaaacctctctcacacacactcacacaccacaaatgtgtgaaagccacctcagaatgccacaatcccacaacacctgcaagaagcgcagcattcgcatactttcagtaggagcggtgctgctgctgctgactacctctttctcttcagctaaacctgctgctcctgatccagcgtcaaagcctgcacagagtgctgctgttgacagcaacgtggtctcttccggcaatatcattcactcgatcggattcctgccttgctccgcatcttcagcatcctcttcaggtgatggggagccagatggggatggggtccaactcagaaaccttgcacttttgtacgattcacagtccaacatgatcatgctgacggcggacggatcctccagagtcaagattgacgcgacatcaggtagggggcccccatctttggtcgtatcttctgcgccattgatttcgatttttgcttcaaggtactgacaaccttccacccccttcctgctgcccctacatcgctcaaaaagcgcatattgtgctcaacgcatacgatcgcgtactttacgaccagatggtggatctcgccaaggccacgtcgcttgttcctcagtgagtagtgtctctttggttctccctccccctactggcatggccgccagtcgtttcttcattttcaccacttcctaacaatcatccacgttctctccggacgaacagagtcgcaggcaaattctcgattgaaaagtcattcccagcgccagctctgctgccaacccagctcccaaaacaactgttctcagtcccagcagtggaggcactggccatgatccaactctacgactctcacaacaagcccatcctctgcgcgaccgtacccatgaccaacactgtcagtgcccagtcctcaaccgtcaccatcgcatccgcatctctgaccgcggtcgctgtagctctcactctcttcacaggtgtcctggctgcattctcgtctgctgcagcactgacatccatgcccctgtcggccttgactggagcaggcgccaaaggcagcagtggcctcaccgcagtcgcaggagctggacccggtggtcagcacgcacctgggctctcgccctccgtatgggatgtggtttcattctgtcagttcattgtcatgtcagggtcgttgaacctggaatacccagcgcttcttcgtcaatggacagccaatttcggatggagcatgggcctcgttcaggcagagagctggaaccgagctattgaacgcctgcgatctaggacgacgcgttcgtctacgacagacaccgctggagaggaagctccaagcgccagcagcactgcgcctctcagcaacagtactagcacgaccaccgctggcaacaatagtccgcaagcgatcagcactcgcaccgcagcattcagtgcagtgaattctcaggccgctcagacacttcatacgcgaaccatacaagtgcatggtgggagcaagacagctgaaggatcatttcacgagacaatgctcctagcagcgatcgcacaggaaccagtgcatcagcttgaaaggcgccaagcagctcccattgccccagtaccagtcagtccgccatctatcgtagcccctgcagcacccgcggtagcaccgctcgatacaaccacagctccgtacaatcctgtaccggcaccacctgtacagcaggcacccgtcgcccccgcacctcagctcgctgcaccagtgccgctctcccctccgacatcgccacccccaccactccaggtgcaggtgggtgctcaatggctcccgtcagtgcaagataactcgctcatgaaccgacccacggatctctcctccatcaagccaatcgaggtcgtattcgaaacaccctccacgacggacaaggtcgcaacgccctcgccctcgccctcctcgcccccatcgctgtggccaaaggacgatccctttcgcacgagccccgcgctgagtcctccaggcttcccgtcctttggtcaacagctccacatccctgccaacaacctgttcatgacctccctctttctcttcttcctcttgctgctcaccacctccttggctgcaatggtaatccgcgcctcgctcgaggtctacgcccacctccgtccaggcaaattcaccaaactccggagaaggttcggctcctactacctcggcggcatgctccgcgtgatgctcctcgcttacttcgccgtcgcgaccttggccttttatcaactcaccctcgccgatacctggttcatgaccctcatggccgtcctgaccctcctgagttttatcgccctcgtgagtttcatctcgcttcgcctctggcgcgccgacggaaccagtctcttctttgacgagcggctaaagtccaaatacggcgtcctttacgaccagtacctgctctcgacctattggttcttcatccccgtcttggcctatcagatcctgaaagccgccatcgtcgggctcggtcaagggcgcggctttggttacaaggacgacatgctggtcgatgggggcggtggacggcccggtcggcatcatggctcgtccgatgcttgggcccaaaccagtctgctgttgctggtcgaactcttgtttgcggcgctcatgatctggaaacgaccttttgcggatcgagcccccaatcgcttgaacgctgtgctgggatgtgttcgcgtcttgaacgtggtcctgctcgcagtcttgatcgagttcacagcagtctcgtcggtctcacgagccatcattggaatggtcatcatgggaacacaggccgtcgtcatgctcgtgatcggctgcctcgtgttttatcaactcggtcaactcctttggagggtttggtcagcgtccagagctgacaaaaaagtcaatagctcatcgagcaaacgatgtctgttcacggtcagcaaagaagtcgaagagatggtggtggtctcggtcaagcacgaccagggacgggatcgtctgcgagatgacgaggacgagtatccgagacggatggcgagtgaacacaagcgagcaggagaaacgggtggctccagtttgctaggaaagataggcacgggctccaatccgacgatctgctgtacacctgccagcgacgatgaagcgagcggtgaagaagaaggcagcagcacagatgaaaagacatttgaaaacgtcgaaatcattgggcgttaccaccatggtcaaggtcgtcgcgactcgctcgtcagcccgtcgcaggacgacgcggtcgaggagcacatgcgagagaccagtggtggctccaaccgcgactcgaccaacagccatgagagcgactcgtcgcacatccttgactactacagtccggcctatctgcccaacagcctccacacggcgccccttcaccataggctctctgtagaggaacaggccatgcgcgcgatgagtctttccgccctgaatggtgatggtgccgaggatcagaatgagcatagagtgcgtcgtgcccgtagcagcctgcatgagggccagagccgcttggtccactttgtgtcggatgttgaccttaaggtgccctggatccagtccgcgtacatgacccgacgccgcagcgagtccatcgctccctgtcttcgcagctcgcgctcctatggcagcagcgccaatgggcttacgaccgctcgcaatcgctcgtcactgcagccgcagcagcgccgccgtcccgtctctgatggggctgcgtgccacagtctcgaccccttgacccttgcctctttgtcgtcatcaaagctctcgcgctccaggagcgtgcgattgagtcgcaggtcctctgcctcctctgagacccattctagtttccagcccacattcatccccgagagtcttctctgcggaccgccccctcccccactgatgatgcaacagcagcccagacaagtcctcgtctcgcccagtgcagtgatcacgtcgccctcgagctccccaatcttgatcgttcccccaacgaccgatgatgccgagctgccttcacccacctccactgtatctgaacctttgcgagaagtccccgatttgtctggcgatccaaacttcacagaataccgctttccagacgagcagctgccccttcctcctcctactcgcgacggacaagtcaatgctacactccagcgattgactggcgccagtactgggcagagagatattcacccactctcgcccttccatcgcgactttcagcatcctgacgaccattacaacccatccgcgtcctcccccaacgactctggccaagcgaacatcaacacggctcaaaacggaaagggctccagacgtgagaaccgatattctgatccctttgggctttcgtccttctcgagtaccttcacctcagcttccaaaccaccccccatgaccggcggtacggcttcaaagcctgttcacaagaagagagttgcaccaggactgaagatcaatacgaccttgaagatgggtttcagctccttgtccccaccgcctcccgagatgcccttacccgcgcttccgccgaccccgttcacagcgacccgtcatgatgacgctcctgctactggttcgtctcgacttcaggtttgcgaaagcgaagacagttcgagagcgtctgtcgcaccctccagtagcatcatccctgtgctgaccaaggacagtttagcagctcagcagcagcctacacccacttccacgggctcagtctcgatggcgatggctctgcacgaggatccgcaacagagtgctccaatacaacagtcgaatggcaccgcaggtctgcagcgtcgacacagcagatcgtcccattcgcatgttgtcgagtgctccatggagagtattgccggaagcagcgccgagtcgtcgccgctaacgcgtcaacgcgcgcttgctcttgcaacgactcctatcccacggtcgtcgcgtcctctgaccgtcagtggcatccacagatcctcaggagctgcccgataaaaaaaacccccgaatttgctgctgtgtagaggcgggttccatatttccttatctgtatcctgataaatgtcgataaagcgcgcacacatatacacttagagagagagggttgtcgtgcagcgccacttttataataatgagccgagtgatagttagagctcaatgatcttgggccgtgggccgtcatgcataaagacgctttgatcctcatccgcttccacagcatccgatgttgccgtttctctgtcttcgcctttttctgtctcgccgtcgtcctcatccgaggagtcatcatcgtcgctcgaggtatcgtccgaatcatccgagtcctcgtccgagtcggattcttcttcatcgtcttcctcctcctcgggcaattccttggccaagttttccagttcctgaaggtgccatcctagctcggatttgtcgagttcgaaatgatggagttcatgcgccaacgtcctgatcaccatttcactacaaaagcaatataaagaaagaaccacagatggtcgtcagcaaccaacccgcagagaacgataaaaaggcaaacagaagcgctaccattaacagaacgcattctttcttacctagcgctctggatccagacacagtagtcctcgataaacatcttgctgtaaatgtaatacacgtcgtcgtggtcgagcacatccttgatggccaacaacgctctcaggatgcccctccgtcccagcttgaagatcacatagacatcctgaaggactttgttcgccagattccagttgcgcgtgagagggtaggcgagcgccctcctgtaacaagtcagcacagtctctctcaacgtcgtaaactgatccaatgctgccatcgacggcgacaacttgcaaatcgtccacgcagtctcgacggttgtgtcgccttctgacacccggagatcatagctgtacgcaaagaggatgtcgatcaaacccaggtaggtcgactttgtgttctcaagaatatctaaattagtcagttgaagagagcaggtgatgcgatgaataagaaagccgttgggatttgagcgctgcatataaaccttcggggtttcacgacgctgctgatcaagtacgtacattctctccgtgggagatctcgcatcaattcctgttcctttgtggagaagagcttgacacctggtaccgagtctccagcagatagagtcatgtccgccatgtcatccactagttcactgttcaaggatggcctcgaagggtccacaacttggatcgagtgcgctcccaaatgcttgactggttcactctcatcaatcaatggctcaatcataggactgacagagtcgatagtgggcttagaagtcgattccatgtccaggatcaaactgccatttccactagccttgacaggctccgtgatgctttccgatatagtcttggtcgaaatctctcgcagaccgaatatatcctcctgacttgacgataaagactcttcagactcatccttgatgatattgaaaatagatggtgttgagggctgggtctgactggaggagaggagcgttgacttgaaagacgtggtcgttgtacatgctgcaggtgacaatgtcgtcgtggtggccgtcgatccaacatcttgtgttgcagctttgccctttttgctagatgctggtgatatagcacagagaagtaagcttaacagatctgacatctgtcctgtcgtaatgcatgacttgacggattattcgtgtacctttttctgccttttgaatatcacgcagttcattccaccactgtgtcttgaacttcaaaatgtgctggatttcctcctcgttcataaagtcgctcctacgcagcacaaaaaaaaggttcatgtcaaaatcatatgtcgcgtggttgtcctggcttcctccatagcgcgactagcaatacgctcttacatgtagtactcgtcgtcaaacttgtcattctcgcgcctgattctattctcccgtctgacctccaaagtggcatgctccgggtcatacacatccaggacatcgttggcggtttcctgcacatgagtaaagaatccataatagcgattattgaatccgtaacgcacttccgagaacacctagcggatggaccatagccaactggttagttcataggggatccaagagccattctcatttagatctagccacatttctactccttttacctcttgcctgatctcctgcggcatttcccagtcaaagtgttcatccctctcggccttttcggtaccctccagggtttctccgctgctgatcacctcaatcagcggccgcttgatctgcttctcacccagatcggccttgcgaaccagtagcttggtcagcatgtccaggtcgggaaagtcctctccaggcgtttccttgggaagaatcaccgtcaagtctccctctgcaacgttgtaggttgccttggcgcgctcgtcgtccactacatttcccggaaacgtgagtctattacgatccgagaccgaaaaaaaaagtatctgcgtaagtaagcgcaagaaaaagctttcaggtggagcggcgagagcgaaagagttcgtcccacgcacctgagaaagtacggcttcaggttgaacttgaagacagcgccgtcgacttcaaagtccacgctctgggtctagtaaacaatggcaaggaagaaaaaagggtcccatttgggcttagctcaagctcatggccatgagcacgcaggaattgagttttttgtggaagagtggtgcgtctgccgaaccttgatgtgcggtgccttgatgacgatggtcaccgagtcgctgtcctgcgagactgtgaaggcgggagtgatcatggcaggtgtgtgtggaatgggaacagcagacggcagaaagagaaaaaaaaaagagaacaaggactgacagctttgtgttgaccacaaaaaaaaaaaaaaaaagaaagaaggaaaagaacagtcccacgatcccgtcaatttattacatgtgcaacatgtacgatatgctctgctgatcattgccgctcgtccttgaactcggaatattcgcggatccgccgcacgcgccttcgcttcatctcctggtatgtgccaaagagattggccaagtccttgacaaccacgaaaagacatccacccaagatgttgcgatgaaatgtatccgggacgcgcgtccttacaaacgaaaagtggcccagaaagctaaaatcaaaggtcgcgtcgttgtcagcgtctagaacacctaccaaaaccaaaacgcgtagcccccaagagcaagcagcagatgtttgtttaccttccgcagattgaagatatagccggcataagaagagccccgacaatcgtcctgcccaaatccttcctgtcaaagaatggcatctcgtcatcgggcatcggcactatctcaaagtcaccaggattgcctcctgtcgccgctgctgcagctgccgcatctgcatccatagtgtcaatgcttgcactcatgcctagtcgtgccacgccagatcctgcaatctgttgctgccgccagcgatgctccaggcgagaaaccatccctgtccacagactgttgtatgccattctgatccatggcatgacggacaaggtcaatgctgggctgggagggaagctgacgcgtagttgttcgttaccgacgatgagtaatgggacgagcggcatgaatgagtcgatcagctttgtcctagagaagataaggatgactggaatgagcggaagtcccgtctacagatgattgagaacgagtaagtcgaaagccttcgcgtcagttgcgtatctgaagcccgaaagcacatcttacagcaccctgagaacgttatccttacccaaacgcgccaactccatggactagggcttcccagaagcttctcgccttcctctgtgccgcaaacagtgaggacagcatatgctctaggatgccaaggattggagacatggaaaagatgtaaatttcatgcgcagtgacccgggtctcgtcgcaaagagtatcgaatcaagacattgccttacccgtaggtggtacttgtgatgaggacagagcaggtcaggcccaagacagtcagataaggaatgccggcgtggatgagggagtcaaaggtcgagtagacattcagcagcatggagtttggctccgcgagccggtaggctgtgttgcataccgagcaacggacctagtcaatgacatcgtccggcacatggaggtcaaagcagaagggcagtacttgtcagcaatctgttccactggaggggctgagcgagaaggctgaacgggcaccccaaagtgcatctttgcgccgttagccaactgacctgtttctttgcgaactgcagccgattcttgtcaatccagtccaggagacaatcctcgtgtgagaccaaggtgcactggcatggcctgacccaccgcccttcgctgtcctcttcagtgccaaagcagatgtagcagcgattttgctcttggtaagctggttggtaaacaggcggtggtgcagcagagcctgagttctgggacagcggttgtgtcctcgaccgagccgagatggtttccagttccttcaagaacgttgacgcgcttgttcctgcgctggagctgctcgaggcactcgaggttgtcttatcgtacaggctgctgctgttcagattcgaggacgatatgttggcgagtcccgctgctgactgggttgaggacgaggcaggtgctggctccattgcaatgctggattcactggatggctaatgtgaaagggaagtagatctagctgtggggtctttggtcgaagcagtgacaaggcgtgtgtgtatcgtatgcgtatgtctgactgtctgtctgtgtgtctgtctgtgggtgtgtgttagagacgtgatggccggtgatgttgggcgtgggtggaagcgaatgcaaagcgcgcatgcggagcagacacaagtgacccccagcaccccgtaataggctccatctgccttcaagggatcatctgcaccatctccaacaggcaacagcgcaccttgttctcgtcccattcatcttctgcttgcatccctctcgtccacatcgccccatcatgagctctgcatccccatccgaactggtatggccaacctctcttctctcaacagctactctcatcggctcagcagtctcgcacgcgtcttccgcttttggcacagcgcattcgagtgcaagtgcaagaggtgtgccacgtcaaactcgcgagtgctaaccatccttgctacggccgccgtttaattagtacgctgcctggtcaacagggacgccattcagtccgcctttgccaacctcgtcacatcctctccttgccacgctgacattgtcactgggactcttctttgcagcaaagtttggcatgtaagtgacagtctcgcgttctgttagttgcctatttatcagtcgcaacggctatctagttcgcgccctttcccttggccaaaaaaaaaaaaaaaagaaatgcctttacgctaacgttcttgtcctattaatttttcagtgcggagaagccggctctgcttcatgatcttgcgacctcgattccaagcgcgatcctgctcggatgtggcgtcgtgttcctgttcctctctgttggcctctacctgtgagtctagccctccctctcgactgcacagaccccagccaggaacacacagagaagcaggcaaactctggctatccagccggtctggttcagaaaaactgagatttgttcaataaatcgaacgcatgttggcgttgctgtgattgagacaaagtgaagacaagtgaagacagcaagcgcagacaaggaaagacgggaaagacaggcagtaggtctaaaaggatgagtaagcacgcggggacggcagccagggtaggagaggccatcgcccgtcccttgaggacaaggacatgaaggccaaggcgttcaggggttgttggcgcactggggatacgagtgattgatgtagtcgatgaaaaatgaaaatgtaaatgaaaatgaaaaaaagaaaatgcgctcgcggtcactcgacccttgttccttcccaggttgcttccctgccctgtcaatctattgctcttgaccccttctggtctgcattatcaccaccactcgcccgcccgccatcgtccctcatccgcaccaccctgccacctgccctaccctgccctgccctgccctgcccgtctagccctgctgcatcgcgcgtccttcccgtctccagcagcagagacccgtccttggtgctgtccctgattcatgaccgcgcttctcctcatcccgtcgtctgtcttgctcacccttcccgggacatccctctggaaccaccaccacttgagccttatcacctcgctcctgctcggcttctttttcgccgcccagcccgcccatcccactgcccacgactcctttgcatcgccctctgtcctgattccgccgtcctcgtcccagtcactcttgtccacattctcgcctgcggtcacattcctcgtccttttcggtcttttagtcgccatgaccgtcgacgacgccgtgatgcagaagctgtggaagctgaccaacgaactgaccgcccagctagtcttcaacaggaacgccactctggaactcaagcagcagctggcagaccttcaggtgggttggcctgccgccctgaccgctacgttgtgtgcacacctttttgcacgtcatggctcacaagaaactataagctcactatgaccccaccgcttctccgactcgcatgtcatccttctcgcttctcctctgatatccttataggccaagacagcggttcagggatctgttacgattgcctcggacgtatcacagaccagaagccaaggtatattcgcgcaaaatcctcgtggtagcctttttttttttttttttgtttttttagctcgtgccgaagcctcacagtttggcatgacttgacacgtcggttagaacacgcggattataccctcaggatagcaaacgagcggctcatggaagaaaactcgcagttgcaggagcagcttcgggaatacgagcgatggatggagtatattatggccaaatttcgtcttcagaacgtaagcagtgtttcatactcttttctatgcagccatctcattgtagcgggttcactcgcaaagctgatgcccagcaactgatattttgatattcacgttcgcatagtttgccatggctcaaagtaggaaggaagcaatgcacgaagcgtacagaatggtagaacaggaaggggtaagcgaaatcgatcaagaaacaaacccgcagaagcgaggtgctgacgctgctgaagcacactgtgttgttaacagagtcgagattgtcttacatgacgctcaataggagctctcgcaccgactacaggaggaaaacgcgattcttcaagcgcgtcttgttgaggttggggccattgctcgcaaggccatcacagatgaatattacaacacagagtcgatcatagagacgctcgagactgaaaatcagggacttcgagaaatgttgggagttgcagcagatcacgcgaatattatggcgacacgacattccgggaaccgggtctcgttccccagcacggagtcttatatggcatctagtggcagtgatcgggaacctcaacatggattcgagcatgctccggatatggtagcgcgtgatgaggaggctgcccttgccagtagccctgagcctgtaccaaacattgtcgacaaagtagagcctatttcaaatccgacttcaagtcaagtcgagcctcttgctgagaaggtcggcgccaaggcagaggtgacgaccgttgtggacggggcccgtaaagcaaaggcgaatcctaaagggccaaaggagacggtgtccacccctatcaagagcagtacgaatcatcatccaaacatcgccagcacgagcagcagtaacaccaaagctagcaacagcaacagcaacagcaaccagaccgacgttaacaaccacagtagccccagtaccagcaacagccagagcagtaaaagcagcaaagccaatggagctacggacggcaaagctgcagggccaggggtaggcactgccagtccaggatccaaaagaaatagcatgaccagccacaacaacaacaatatcagcaataacagcagtaacagcaataacagcaacaacagcagctgcaacagcaacagcaacacaggtacagtggccaagagcaccgctaccgacaacagcttgacatcacaaaaatccaagaagcccaacaggaagcaaaaggcatgagaggtgcatcaatacacttatcatttactttcaggcactatgcatgcagaccaacactgagcagggacacgtttgttgttgttgttgtgtttgtgctgttgactcaagagtctaaacaggcggcaggacatgtgggtgcagctgcaggcccctttttctgccgtctccaagtacgatacaggggtatgtcttatggagacacccagatgatgcagctgcgtgtcactcactcccactgggcttgggcgaagggcacattttttatatatttttcgtttcgtcgtttctctttttcttttgttcgctctgttcgctctgttcgctctgttcgcctgcagtcccttcactgtccctctgcccttcatcctctcgctcctctgcctgccagtcattgtcattgtccctggttgctcgtgcgcctcatcgcctcgtgcctccaccgccccatccaccgcactgcagtatacccctccttgacatagagggcacgcagccatcagacgtgtctgcccgagccattcttcttctgcactcgcgcatcgctttcttgcattctctttctggccatcaccctccccctcgctcaatcactgactggaatgaccaaaggcacgcgacatgtcgccaataaggaaccacgcgcagccacagcgacgccgggtccgagcacacagcccagcgaccttgcagctgccgaaaaacctcgccaacctgctcagccctatgcacgcatccagctgactgtagagcccgactgctttattctccagccctactgcgatcagacgaacgagcgcagcactgccctcccgcacagtcgtcacacagacctggtccgaatccgtttcaaggcggttgaagccgaggcaggaacagtcgataaggctcattctacaggaagcaccgcctctgggggccttgtagagaggcaagctggccgcgtgtcttttctatctcaacgtatgttgcagcacccatgatgctcagccggttatcttcttctatgcgttgtatggttatgactaaactccatttttcttctttttttataacaggatcgtacacgaggtcgggggctgctcgagactacatcatctatggctgtgttggattgctggacctgcataccggttagttaaggctcgtcaaaccccacccttgtgttgatggtatcatgagaaacgacgtttaacaagtcttgtcctcacgacaccaataggccctcatttcatcgtcatcacgtccatcaaggccttgggagacatcgaggacaaggccatatacgcgatcaataaggttgcagtgctgccaatggagccgcagactgcttgcgacgtgctggacagaatggcccaatggatcgacccacttcttggaccgattcttcaagtggagccgccaccggagacatcgagcgatttgcaggcacctgcttcagaggaggctccaggaggcgagcagcattcagcagagctgtcaaagtcgccaaagatcagattttcgttcctgggagcaaagcacgacaaaggagtgcagaaaccggccaacaatccaagtctaccgttggagtcgggcaaagctgcgactggcatcgcaagcacgaaccacacacctgcctcagcaagcaggaagctttcgttcgatattccacgactgaatactggctccaagggtaacagcagccctacgagctcgtcgaaaatcaacgcgccccagtctggctcaccaatgttgtctccttcgcctcgctcgacacaacccggcttctttgcgaaactgaaggacagcatgcttgacataaagtcacccagaacgagtctggatgttgccacgccccagcgatcactctcgggaagtgaaacaagctctttaacaaacgtcgatttcatcaccgtgacatcacaacaggcagttgaaacccagaagcaacacacccacgcggctcaagtcagtactgttgctacggagggcgaaagaaacgatcaaaaggtcgaaaaaggcgaggataacaaggatgacgaggacgcgcaggaagaagaaatggaaaagaaccgcgtgttggaccggcgtgtcattcgcgagatttcgtccattttcggcacaggattttacttctcgactgaattcaatctcttgtcctcgatgcagaggagatttgatattgccagagatgcatcgcaggacgaggcgcctctttggcagcaggttgacaaacgcttttggtggaatgaatatctgttgaaggagtttctggatatagaggtaacccatcccctttgccaagatcgcttcgccttgttatgttgctatgtcctgttactcaactagtgtctatggcttcctcctctaggctcatggatacatcctaccggtcatgcagggctacgtggagattgaacagtgtgaaattgaggagcagtctttcgagtttacactcatctccaggaggagtagagatcgctctggtttgcgctatcaacgtcgaggaattgatgaagatggaaacacggccaactttgtggagactgaacagttgttacggatcgtggtaagatcataaggactgtctttactatggctgttgtactttgtgaaacccttcatctgccgttggcaccctccactaaaatgcccccctccccctttacgtctgcccaacgtttcattagcgagacgagagtgaccatcaagtttcctttgtgcaaacccgtgggtcgattcctctgttttggtcgcaatcaccttatcgactcaaacccattcctgttcttgagcgctcagagtccgagaacgaggttggcttcaagaaacatgtggatgatcagctcagccgatatgggaaacaaatcttcttcaaccttgtggaacagcatggacgcgaattgattgctgggtctgcgtatactcgacatgtcgaaaagctggcagagccgcgtatcacgtaagtaatcaacagttcgttgcattctttccctttgaaaaggcttccttcgacactgctaatccgccgtcttccgaccctttgcatacatagatacgtcgagtttgattttcatgaacaatgcaggggaatgaagtacgaaaacattgaacgattgatcaagagccaggaggcgcccatcttggacctgggttactgctggctagcccccaggaacaccaaatctgatcagacaaaggatgagtcctttgagcggctctatgaccaaaggggagtcatccggaccaactgcatggactgccttgatcgtaccaatgttgtccagagtgcaattggccgttacatattgaaccaccagctcttgcgactcgggatcgcctcctttcccgacaagggtctctctgtctacgaggactttgaaaacgtgttcaaccacgtctgggccaacaacggggatgcaatcagtcgcgagtatgccggtactagtgcgctgaagggtgactttaccaggaccggcaagcgtaacctgcaagggatgatcaacgacgccactaattccgtggccaggatgtaccaaaacacgttcaaggattactttcgtcaggccactatcgactaccttcttggggcctcaggcgtggacgtgttcaagaacttgcagacaactacctttggaactgtagtcgtgcccccgcccattctgcctcccgagccccaagttcacctctctgcttcggcccctgagcttccagcactcgtaccaatcgagccagcagcagagccaatgaagtctggggcacttttgccgtcattgctcccacactcgtctgtttccttgatgtctttgccctctcactcggcaacgccttcggaggaaaagacactacagcaagaaacgtgggtcaagatcagggaggctgcgatcgagacctcggccgagattgtgatctcccctgccgaggagcgatggaagggatggactttcatctgctgttcgaacgagataagcaccgcgctcgcctctgcttcctcaccgcattcatcgccacagcaacccggctcgacaggcaaaaagtttagatctccacggaaacacgggtcaccgtttgcgatctcgacgtccttgaacagcggcgatcggcaagatgacggaccaagatccgcatctgtcttttatgacgagaaggttgtgctcttgacggagaaggcgctctacatctgcacttatgactacgaaatggagaaggttctggagttctggcgtctggcgcttgaaaagatgactggtatcgacaagggcgcttacttcttgacggctcaggacaagacccggataggtcaggatcctctcgaaaactatggctttgcggtggtgtatcgggcgagtgcttcaggagagacgctgcgggtgaacagtggtagcgttcgcaaccgtcggatgatgggtccagcctctcaacgcatgactacagagttggatcgggttccggaactggaagaagacgggcacgatgctcatgcgcaccaccgagattcacgcgagttggcggtcagcagtagtcctgagggcgcggatcttcatgatgacagtcggtccgcaagaagtcttgcccgggatgaacatcaggtgttacggtccgtgcgcttcaagatcgtgaagcacccagaaacgtcggccatgccctttgttacgtcgtcttcggcggaacagctatcgggtcagagcaaggccaacccctcaggttacaaacgaaccgctcaggacggcgtcgagtgggtagtgaccgagattgtgaaggcccgatgtgaactcatctctgtagccgagactacgggcaagagggcgacgctcactgtggacgcagctttgggcgcagcagaggggcatccgggccgagcgccgagcgaggaatacaactatcatccgccacgggaagcacgtcggtcatctgtccaggtcgatctgattattcgggacaggatccttcaaagtctggagacggctgatgaactggaaaaggcgtcgttgaaggaatcagaaaccaagatgaagaagcagaaaaaatcgttctcggactttttttcggcgtcaaaggcttccaaggagcaaggagcacctcagagttccaaggttgagaccagttccggtggtaataacctgtcgtggcttaagaaactgcagtttgggcgggagacggacagtgacacggactatgaggagcagatccagcagcgagcgagagcggaccgagagaaggacatggcggccatcatgccggactcggatcgagctgatgtgttgccagaggtgacggcagccacggaggagatggaaggcgcaggcagtcgcagtcgaagcggcagtttgggcgtgtttgcaaagctcaagcaagcggtcaagaacctttgagagactttcgttctacgcgcctttcgttgaacggtcgtctgttttgtttgaaggtcaaagtataccaccctttttacttggcaaccgtgttcgtccctttgatttttgggactattgcaggggctgctcctgttattctagctgaactgaaaggtcctcttggttcaaaaagcccaggggcatcaagcgctttctcttcgcaatgacagtacctgttttttctttacaatgcattttctgctgtccttcgtaatggcagtctgcttgcacttcacaacagcattgtctgctttctcttcgccttgggtcgatcaggcggatggtcaacggccgtcatactttgagaaacggcgcaccactagcacgtggcttcgacatgtatagaggacttcgatttctttttcgcatggtttgttgtatttgtctttgtacagatcggtcgtgatttcgaggggaggctacaaatccatggacatctggtgcctcttgtaaacgctcatgatcttggctacgaatgcttccaaatgaaaaatggctttctgtccggttcggagtcggtgttcatagaacgctgcctcctgtgcgaaccgcatcttgagatcattcccgtctactttcgcaatgagctcctttgccagcgtctgtttgggcaaaaagttgcgagtaagaacgggttagtatcgcgtctcaatgctactgctgtgccgttatttcgcctctcaacattgttttacctttaggatcgttgctggatcgatgcaatgattgataagttcatacagctggccacggacgatttgtagcctatgatcacaacaggatagtttgttagacaggagatatccacgaccgtatcacacggctttttgattttcatgaaaattcgacgtacgattcagggttctgcattctgaggatttgtgccataacagtgcgaatgaaatcttcccagtccatgcgaggaatttcctggttgtccttgaaagggtgactacagtgatttcaagtttgagcgaacagtaaacgatgttagttttcccgctccaatgaacagtgacattgagtatctgtgagtcacaacgcatgcaccgcgagcctcggtctctgcctcgttaccattgtactttggcagtttcgagcatcagcaatgccctccgaagattccgtcccgattcctctgcaagtctcaaagccaagctctctggcaagggcccacagtgttccttctttacgaccttgtgcagcaccttgcagatgtctggaacagtgggtgctccaacacggacgagcaggcagcgggactggatgggtccaatgatctttgatgtggtgttgcaacacatgatgattcgcaggttgctcatgtatttttccatcgtacggcgcaatcctgcctgagcgtccctagtcagcagatcggcctcatgaatcacgacaactatgtaaaaggcgagggggatgtcagtgttagacgcaatagactgtttccgtttgtctccttctagtgtgtgtaccaggcatccagtctagctttgtttcatacccttgaatcgtttttgagcggatgcatcaacctgctgagtctgagcgacctccttgagtaaatcctggatcacaactctgtcatagtttccgacatcactaggatcgaagagacgtgttcgtgttggtcaggacgcaaggcattgaggtcatccgtgagctgcctgactttgtgtaagttgttctttaggatgatccaagggctcacctcgggttgacttccagatgatagttactggaaacgatgttcagctctagtttcctctttgagggtgtctcaaagatacgctggtcgattttgatctaaagagcgggtatgggcagcagaagctgagaaccggagtgacacaagccatcaacgtacacctcttgtctatagcagtggccaagttaagcgtaccttttctgagccaggtccaaagagttcacggaggacagccaccacgcgcgtcttcttgccggctcctggaggaccaaagacgagcatgtgaggaaagtcgcccgatgcacactagtgaatgtgacaaggtgtaggtcagcgtttcgcacttttttcttttttttttggtggcggttcagtcttagcgcgatgggaggaaggacgagagccgatgggaggaaggacgagagagtgagagagattgcggtgagcgtaccagtttcttcaggtgcagcgagagatctgtgtggtagtcgagcttgtcgaggtttgtggggcggtgcttgtctacccagagagccatggcggagagcgtgctgtgtcgaatggaagaacggtgggcgatgaagaggcgtggcgagcaaaaaaaaacgcgctttttggtggcaagcaaacaaaggagcagtcctaaatgaactgatcgagaccactgcgctcaggagaaaaagagcccagccctctcctgctttctatccccctcttctcgcgcataggatgatacttctctatgccaaaacatgccgcagtcttatggtcgtgaattgccggtagtaggggcgccatgattgttacctagcgcattcggaggttctccgtatcgaagcgttggtctcgtgcagttggcggtagtattatatagctcataccgtgatctccaaatacggtgacgaaatctaactctgattttgatttttttttttgttttttgagcaggcgatcattgcagacgctctgcatcctcacctccaccacacccatcagaccttgctgcaatgccgccaaagaagggaaacaagaagaagaagcaggacgactactggtaataaaacacggaaacacccgccaggcgaccatccacccacccactgcacatcgtgcttttcgcatccgtctcaatcgctcaacgacgcacagattcacagcacaggagagcgagcggaaaaagttgatctcctgacgagcccggctcgcctttgctgcggcgcgattttcgatttcagcgctgtccctcggaacaactacctcctattccagcctgccccagaacctctctccacactgcactcccactctgtctctcgtgctcctttgaaatctcggactgacagacggtttggtctcttttttgctgtcgtgtgtactcgctcatagggagaacgagttcgagcaggatcaggaagctcttggcgtcaccggcacacccgaggaggccgaggtcgtcgtccccgatcatgttgcacatgaggatgatgatgctgagggtggtctcatgagcatggtcgccaaggcgtccaagaagaaggccgctcccaaggccgcctcgcccgcccccgaggatgatcaggatgagctcgacgatggcgaacccgtggtcaggatcaagacgaagaaggagaaggagcgcgagaagaaggagcgtgagaaggagaagaagcgtcttgccgctgaaaaggccaagaaggagaaccccaagccggatgttgccgagaaggccgaggaacccaagcaggaatcgacccccgcaccagcacctgcccaggacgatgacgacgatgacgaggatgagactacgggatcaaagtcaaagaacaagaagaagaagaagaaggccgctgccgctgctcccaaggaagaggtcaagcccaagaagaagggccctgccggtctcggtgctctcaaggtacggtgtttacagtgatcatgattctgaggatggttcatacccaatgacgtcaaacgctaatcgaggacttgtgttcaattttttttcaggccatgctggagaagcagagggctgaggaagaggaggcacgccgcattttcgaagaagagcaggccaaggaggccgagagacttcgcaagatcgaggaagaagaggcagagaaggctgccttgaaggcaaagaagaaggagaaggagagggccaagctggagcagaagcgcaaggacggcacgcttttgaccaaggctcagaaggaagctcaagccaaggccgctcttcgtaagcagcagctcttggagtcaggcgtcatcgtcgagggccttgagaagactggcgagactgacaccaagaagaaggtcgtttacggcaacaagaagaagaagggctcccagcagaaccagaccccaccaccctcatcgcccaagatttcagcgcctgttgagattgttacaccagtctctgccgcagtttctgagaaggacgaggcctctgccgacgattgggaggccgcagctgagaaggtggacgaggttgaggaggacgattgggaggctgcagccgagaaggttgatgagaaggaggaagaagaggacgtcaaggatagctgggatcagagcagtgacgaggagaaggagcagaagccaaaggctgccgccaagaccgcacctgccaaggctgcacccaccaaacccgcacctgctaaagctgcccctgccaaggctgctccctccaaagcaccagccaagaagggcactgccgccaacaagaagggtgcaccagccaagaagcaacccgagcccgaatctgaatcctctgaggaagattccgatgatgactcggacgacgactcggatgactcttcggattactccgactcggattctgacgactcggactcggactcggaacgcgagacctctaccgccaaagccgagcgcattcgcaaggagcaggctgctgagcgcaggaaggcacgtgttgaagccgccatggctgcccgttctgctgatgatttgcgttcgcctatttgctgtattctcggacacgtcgatactggaaagaccaagcttctggacaagattcgtcagaccaacgttcaggagggcgaggctggaggaatcactcagcagattggtgccacctacttccccctggagaccatcaaggccaagactgcggttctgaacaaggatggctccaaggtctacaagctccctggtctcttggtcatcgatacccccggacacgagtccttcacgaacttgcgttcccgtggttcttcgctctgtaacattgccatcttggtcgtcgatattatgcacggtctcgagccccaaacgctcgagtctctcaagctgctccgcgacaagaagacgcctttcatcgttgccctgaacaagattgatcgtatctatggctggaaggccatccctgacaactcgttcgtcgattcgcttgcacagcagacaaagtcggttcagcaagagtttgagacccgcaagaacgccaccattacggccttccaggagaacggactgaacgccgagctctactacgacaacaaaaacatgggcaagtacgtctccctggtgcccacctctgcacatactggtgagggtatccccgacatgatcatgttgttggtcgagctgacgcagacccgtatgagcgaacgcctcatgtacatttccgagctggagtgtacggttttggaagttaaggtcattgagggtctcggaaccacgatcgatgtggtcctgtccaacggtgtgctgagggaaggtgaccgtatcgtcctttgcggtctaaacggagccatcgcaaccaacgttcgtgcactgttgacgccacagcccctgaaggagttgcgtgtcaagtccgcctatgttcataacaaggaagtcaaggcctcgttgggtatcaagatttctgccccagatctggagaaggccattgctggttcccgcctcttggtggttggacctgatgatgatgaggaccaattgaaggacgaggtcatgagcgacttgaagtcgctcttgacatcgatcgacaagtctggccaaggtgtctgtgtacaggcttcgactttgggatccctggaggccttgctcgagttcttgagagtgtccaagattcccgtctctggaatcaacattggacccgtgcacaagaaggatattatgcgcgcaagtaccatgttggaaaagtccaaggaactggcctgtttgctgtgcttcgatgtcaaggttgacaaggaggcggagcagatggccgaggagatgggcatcagggtgttcaaggccgatattatctaccacttgtttgaccagttcacagcctatcacaaccagctcacagaagagcgtcgcaaggatcaggctccctccgctgtcttcccctgtgttctcaagatggtgcctggtgccatcttcaacaagaaggaccccatcattatcggagtggatgttgttgacggcgtgatgaagcaaggaacccccctgtgtgtcatcaatgtggatcccgaaaccaaggccaaggagattgtgtatctcggaaagatcacctcgatggaacagaaccacaagcaggttgataccgtcaagaagggtgcctcgggaggaggaatcgccatcaagatcgagtgcgctgtgtatgagaacgccaagaccttcggaaggcatttcaacgagcagtcagaattctactcgatgatctcgcgcgagtcgatcaacattctgaaggagtcgttccgtaatgacttgacgaaggacgagtgggccctggtcgtcaagctgaagtccaagtacgtctatcaattatgtttcgttggtgctgatgctttgttgttgatggctaatctcgctcttactaacatctctactcctcctcttctttttctcaggttggatattgtttaaagcatcataaaaaaaaagtatcattaaaattttccgcttttccttttcatgctcttccttgtgcttttcgttttcatggtcctccttgtagcagacagcggggcgcttggccttgacgattctcgaacatgcatgatgtaaagtcgagcagctcagattatgcacttacattggagtggtcaatcatggcggaaacattgcatgatagccattgtggcacggttgccgaccattagcctgactcacccccaatcgaccgatgagaggcgcgaatagaggtgatgatatggttagaaaggcttagaaggtaccagagccataacagtagcgtttgtgcctgaattcgatattttaaagtttatgcactgtgcagagcgcctgacagtcctcgcaaatcgtgtagagtgcctggcgctgccattctgcgcaccaggtcgccatgcggggccccatattcgtcaccgcacccactgctagctacatagtgttacacacacctctcgtaggcgacttggttgatgcacttttggccgcttgctcgttccaaccacttttcccgagatctgagagtgtgcggattcgcgtaaggcactgtttttggcgattgctcgtcttgaccatccgagttgcggattcgacccgatctcaaaggagagaaggtcgattcacgagcgcaaatgttgtccattcacaaaaatcgttataatttgaaatcaagcagctcggacgaaagcgccagctctggagagggcaacggtaccggtggcatcgaaatataatggatttatacaccgtttatacactcttgacgaccattcgcaagaactggccctgatcggccaatgaggcgcgccggatgggatgtatgtatggtccatatgggccaagtgaatatgctggaccatagtaggggttgtagtacaaaagtgcaggtgcctgaattcaattttcaaggttttcgcactctgcccattcaacaattcgctgcaaacccaccgtgcaggctgtataatacgccaaagagttgtcgtggaccgctggcgctgctacaaaaggcgacagggagccatcgcaagtcctagagcctcataagctctctatagcatatattgggacacctatgcaggtctttcgcaagcgagtttactaatgcaatttttcgagaatgtttgttccattcacttttcacagggtctgcgagtgtgtcctttcgcgtgaagcactgttttcaatgattgctcatcttgaccatccgagttgcagattcgaccctattgttcttgacagaagcgcgcttgaccagtgcgaatgtcaacgaatgtcgaaatgtattatatttgcgattcaagcagctcggtcgaaagccctcgctctggagaggccatccgtaccggtggcatcgagatataatggattatacatcggattatacacgtttatatcctgtcagcgaccatttgcaagaaccgcccctgatcggccaatgagagttgccggatggggtacatggatgcttactatgggccattggaaaataccgaggtcagagtaggggctgtagtccaaaagtgctggtgcctgaattcgattcttttaggttttcggactctgcccgtgcaaccattcgctgcaaaaccaccgtgcaggcagtataatacgccaaagagtcatcgtggaccgctggcacggctgtctagggcgccagggagccattagagtttttagagcctcttgcagcactctaccatgcacccatatattaaaacccctgtgagcaactttcggaggcgaggtaggctaatgcaattcatggcgcctgagcattgcgaccgcttttcccgacctctgagagtgtgctgaatatcgtgaggcactgttttcagtgattgctcatcgagaccatctgagtagcaaaacgagctacttttaaagggcagaaagacaatgaacgggttcgagaagcaccaagttcatggaaactatagtaatatgaattgtaagcgagtgggagaaagcgctcgctcgggagaagccaaccgtaccagcagcatcgaattatcattgtttttgcaccggcaacgaccatttgccattgcaagaacagcgctgatcaaagataaaaagacgatgggcggttgcgaataggaccaaattcgcggaaacttttacaatgtgtatattaagcgcatgggactaagcgctccctcgggagaagccaaccataccagcagcatcgaattataatcgcttttgcaccggcgacgaccatttgcaagaaccagccctgatcgaaggtatatgggcgctggcaccctggacctattagtttaaggtttttgcgctgtgacactgaaataaaacgctgcagaaacaccgtgcgacgcgccatcaagtcgtgcagtccgcattgagtgtctggcgttgccaccgagggaaccgcgtatccatggagagccctagagtactctccagcactctcattgatagcaatgtagcgtcagctgaccccaacttcagccggcgacttgcctaatgagaatgttggagaatgatcttcaatctgcattcgcatcgaggtttcagagggtggagagtggtgtgaggcagtttatatacagattggcgatcttgaacaggcgagtagccgaatcgacccgttcagcctggggaggggcctttgaccatggcgacatggcgaattcagcagatttaggaatttggtcggacaagcgattcaagtagctaggacgaaagccctcgctctggaggagccaaccatgccgctatcatcgcattatcgtgactttggccctagttgacgaccatgcgcaagatatggctctgatcggccaatgagaggcgccgaatggggtatatgcatggttgctatgggcaatatgaaggcgctagggctcatagtgaagtcctagttaaaattgccagtgcctgaatgctatttttttaggtttacgcgctctgtccgtgcaacaattccttgcaagaccaccgtgcagcctgtataacacgccaaagagtcatcgtggtccgctggcgcggctgtccaggtcgccaggtagcgattaaagggttctagagccctgtattactctagcgtagagtgaaacatttgtgcacagcttttggaggtgagtttcccgatcatttcaaaccgagggttgatagcgtgctgaagcgcgttaagcatccctttcagcatcaactcatctccactatgtgatgcgacatcaacttgttcgtcgaaaaagttttgcgtagccaaaaaaaagaatgtgctgtatttttatgtaatgaagagcataggtgagagtagaaaggaaggagggggctgcgaaggagtctatttcttggcctttttggcaggtcggtctcccgatttagtatcgtcctcgtcatccgagccacccgatccgcctgaatcactgacgttctcatcaaactcctcagcgacatcactctcactctcggccacaaagtcctcgtcagctgggatacccaaacgatcaaagaaaaagcaaaaacagaaaaaaaaagaatgtgttagctcacacatacatctaatacaacagccgatagaaaacaaagaatacgagaccgctgcaggtgtgcacttacggctggattcaccctcgtcatcatcaccgccaaagtcctggacaatcgactttctcttgcgcttgcccgtgtcctcgtccgaatcactctcatctgccatctcgacataacggcctgtggactcgtcctccatcgatttggtcttgatcttcttgttctgcaagaactcgtttaggttggcgtactcctcacggttgatgctcgagaacgagtagtctacgccagacttcatgttgaacttgagatcaaacgtcctggaggctgatgtggccgtaccgcccacacgcgagaacgtcactgagccaatctcggaatggggaatgaatgttgggggcttggggatgaaaaggaaagacttgtcgagtggatagagaactccctcgttggccttcatggaacacttgatggccgactgattgtggtaactcttgaagaactctgagggaatggtgacacgacggccggtcaaggccttgaagagcgtactcacgacctcatatgtccttgtctcgtacttcttttccagcttgccctcgtacttgcttgcgatggtctcctcgtccagattcagcgtcacatctgtttcctcctcccttacaaactggaagaccaagaacgggtacctggtctgaccctgacgaagtggaggatccagtccaatgacaaagagcacatggacgtcatcgggcttgggtagaaggaacagcttgataatgctggtgtatgcaatcttatagtcggtcgtctttccacgcagacggaggaatgtagggaacatgtcaatgtcataacgaccacggggtgtcaagcacaaagtatccgagaagagcacaatgccgtcacccggtgctgcatctccaatatcggcctcgttcttgatcaagttgtagaagacctagatgtgaggaaagtataacaagaaaataaagcaatcagtcgatgtccttagcccgtcatggtctcttaaacaaatttcgtcccattgattctcgcctaaagcacgtacgttggctgcgctctcctcctcgccttcgccctcctgcgccttggttcctggaacatagaatcgcatctcaacgagctgatcggccttcctgttcctatccttctgtgcgccgccctcaccatcaggacctccgagctcgatcatgacctcgtgcttggcagtgagcgatgtgttggtgacctcgttgagtgggatctcgaacatttccttgttttgaacgctaaacaccaagttcccgcctattcacaacaggaaaccaaaggacaagtgatctgcgtgagtggaagaatttctcaagacgaggctgtcgaaagattcgagatgcacatttgcgcttcctagcccatccaaacgtactcgtaaagtcagtctctccccagttccagcccttgacgctcatctcctttgtttccagctgcaagccatagtttgccttgatgatatcctttagtttctcatagtcctacgagtccagaaaaagaagaacggacattatgcgctgcgttagctccaatagggtcccatatgcatcgacccagtgcttctgagcgtgttcgagcgatctacgactccaaaaggaaaactacgagatggatgtccttacgtcgcgctggaatccatcaaacttgacaattctgccatcacgaagctgaatccgcagttgaaagttgcgtgcggcgcgaagccaggtagtcctcttgagatcagcatccctgactgtgaagagtccatcaccctgacgagccttccaacccagtccactctgggccagacgcaacaagcccagctcaggagcgaggcccaggtagatgtcgtcgaactggttgaccttctcgctcatggtgcgctattctcctgtcctgatgtgcctgttcttttgcgatgtttttttttctgtcctgcggggagagtgagcttctggggtcactggtgtccagaagattgagcagtggaatggaaacgtagggtggagaggcagcgttgcaagacagggtgaggactggcgcgtcaagcaagggaaagagggctaatgttgtgctaagccactaattctgacgttccttctgcgcgagtctgctgctgttgcaggctttgtcttgatcaatttcggagactcatcggctccgactcttttttttttccttttctccagtccactcattctcaacactcacacgccatcatgtccagcgtcatcatccgttcattgactcgcacacccttccgcagagctgtccagctccgtcgcggaggccactccgagggatacaaccagcccaccggataccttttcggcgagaaggtactgcagccgcacaccggaatacttggaacacctcctcccctcctcggacatactgaaatcaggagtgggaacttttgacgcacccaggatcgtcctgtcaagtgggagatgtcgatatgcggcaccaatgcagtttgtgacaggaaaccgactttgttgactgcaccaactattcgtagttcgtcgtgttgccattagcgggaattagtctttgaacagcacaggaacacaagtcagccaaacttgctcaccagctcgcctaggaaacaaatcatggaccaccttcgcttctttctcgctacaggaaccatcattctgctgttgtcaagggaaaaaaaaaagtcaatatcacaggactcattcgatacatatcttttcttctcatgacattcgtgtagccccttgcccctggagccaagcgcgtcaaggaggactgggagaacctcttcgtctatggcttcggaggtgccatggtcttgggagctgttttgatgtactacaagcccgataccaacgtccacacttgggcatacagagaggccaaggcaaggatggctgcccgtggtgagactgtcgagtacaagaagcaggaataaagaggcagatccaaggaaatcgtttcgacgcaagactcaaaattagacatcagtggggagcgagcggcgttcaccaggaataaacgcaatcaaacaacaaatgggattgtgtgcacatatcctgcgtttgaatattcatgaagtttttgtttttattgatgccaggttcaggatgctatgcgatattgcttttttttttttgaatgacacacgcgggtaaagtaccatccttcttcctctcctttcagttctcctcgtccgagatatccatgacaccgtctgccatgaacttagacccagctgatttcagaggtcgtgccggtgagggacttgaacttcggaaccgtctcttgctaccgcttccaagactacgcgtgggtgatgcctgacgtgactgaaaccagttgagtgccacattactagccgccttctcgggcgtggtgttcctggaatcataatagggtgaagtcgacgaaggaggcaggttgctcgatccatcactgctacgatagaacctcgacatcaaacgacggaacgattcgtgcactgccttgaccttggatgggtctcgagaaaagacccggatgatgttctcttggaattcacttgggatgagactcgacaccttttccttaggaatatgataggacgctgtgatttggtgggagaaaacaatgatagaagtggtcatattggtcagaacaagcattgactagtgggaaaaaagaagatatgggttcatgtatcttatcacattgcatacctgtattattttgcttcgaaaagaacttgataccgtcgaccgggttctgatccttcatggcatagttgttcttgaggaattcgacaatgacgtcgtcctgcgtgaggtgatcatttgcgccttggcaggagacaatttcggcggcattgatattttgctagatacccatcacatttaaagtcaaaatatcagatcctacactcttgcaaaacaacatcgagcgcaaggcaaccgtaggctttacctttgtcaatcgaccaagtttctcgcggggaattaaaagttcgtccacgaacttgtacaagctacgagttcgcacgcgcttcaagatagccttggactcctccagaccctatagtacaaaggcattgaaaaaagccatgccagttagaactcgaaaagcttaaaaagccggcttctcagaacgacacaaacgtgagtgagccgtacctcaagaggagaccgctcaatttgccttatgatatcgtctgttagatggagatagtcctccccgcgaaagatggacgacgagatgcccatgacactgtctgcagcgaggagcgcatccgtcaacatgtactcaatggcctttccaacacggtgagtatacaccctcttgaagagactgaagcgagtgtgatacagctcgtacaggttatagacctccttgtgatgccaacagatttgatcatcaataaccctcgacatcctcataattcttgagcagtcgaatccagcgcttctaatcccgacattgtagcaatctcgttgcagatagtcgtacttgtccacgtccagagaattgcgtttgttagacacgatgtcaaacaggaatgcagggcgtctaagattcgtatgcagaaagacatcagtacttgttcctgaatttgccattacgtaaaagtcatggaagagactaatacagctgttcacatgcgccaaatgtagtccttacaagctatttcctcgctgctcgcccatgatgagatccttgataaagctgagctcctcgctatcaatatcgactgcgttctcgtcgaccaagtattcgagcatcatctcggagccttgctcatgtgtccatgtcgacccaggaatagctcgaggaataaactcgttgtcaaagacgtggctgtatggtccatgacctagaagaacccgagcgtggaagcttaccatcagtctagaaacataccccgaaaaatcggacacacattggatcccttccggctgttgcactcacctagatcatgacacaatcccgcaagcttgacgcacttgacatcactctcactgatttcaagctctggctgggtatcgcggaacctctcgaccaactctcctgcaagatgcgatgttccgatagagtgctgtggagagagaatcaggccgtggtcagcatcgctcgtagaggcttcatcgagactttacatgctgacgcaccatgaaaacgtacttcaaaccgcttgtgtgtcgcgcctgggaacacataatatgcggaccctagctctgtgtaccagtccaagaaaaaaatagaagattcatatcattggtcattgagagagcaatgataacgatgttccaacactcggtcaggaaaaatgacgtacgcgtgagatctcgaagcctctggaattgaggcgtgtcgatgcagctgaggcaatcactgtcgagcaggacatgtccctatgaggcgcataaggtcgaagaagccaaaagatgtcagtataaagattatggacgaggtggtgactgaccccagtcaccccagcatgcatgctactatccttagtgtgtggccgaaatgcatgctggtcggtaagagggtacgagaaagcgagtgagctgtaacgagagcccaaaagcgatccttcatattggtggcgttttttccgcctgcagttgaaagggcagcgcagaatgatgtgcatgcgcttcccgcagtggtacggagcacgaaaaatgaaaaatgggaacgtctgtgctctatgagcactctcactaaaagtgacaaaagaaggtgcgccttacatgaattgggtcattgatgtacttttcattcgtcccctcgtagacaccagagtcgtcgcggccaaagaggggcgtgaatgagttgcggcggtacaagggacggctctgcttgggcgtgctcaaaatgccgttgttgttgtgatggttgtcgaaggagctcaggtcgaaatcaacggagtcaagcatgccagaacggctgctgtctccatttgagcgagagcgatggacgaatggggaatcgtcgtccattgcgttgtgcgatgtgaagctacagcgagaggagaaggatgcttttattacaaaggagtggaaggaggaagttgtcaatgagaaaaggaaaggaagaagagagaaaagtatataaaaaaagaagacaaggaggcaaacgttgaaaaaaaaatagtatacatttggggagtgaccgacgaatcaccgcagcttcgtcaggcacagtgcagcaccactggccgcttgatacaaacggcagagctaaaccgtggcctggaagatcgtgatgggcttgaatcccatgccgctcgactttttcttgccccctgtctgaccacgaggtccaggggtggccatggtcttgctgaactgaaactgaagccatgagtggaccggcaaatgcgcctgacttcggcgcttcactgctggcaccttgtgggcagcgacagcgggaggcaggatcttgggcaggggtgacatgttttcgacctggggacgacgcacaattcccgccttgaatatgttgctgctgctgctgctagtgctaccgctaccgctgccacaaccaatgccaatgccgctgcctgagggactggagaagcctgcagagctgcctggaccagtgctacgtgaacgagatcgctgaaatggcgtgaagggtgtccgtgcctggccagtctcgaaggccgaagtcaatcgagagaaatctctccagaactcagctggtggctctaccgtgttcttcttggaggatccagtccttggtgctccatcaccatcctgcgaatgctccatgccgtggatctctggtggtttcgggggcatgatggggtccagtaaccaagaaataggaatgttggcaagtctgggtgagggctgcggctgcgctatcggctgtggatgggactgcggcctttgcattggcgcttggagttcgatattggtagggttgcttggatgtgaaatctccttcagctttggtggggccatgagtttgatattccgctcggtggctcttgatatcgctggcatagcataccgccggttctgttggatgatcatcttgatgaaggacatgcactcctgttccgacagaaccaactctgacacgtattccgatgtgttgtcaacacgcctttcaagccagtcaatacgaacttcccaattcgtgacggacccaacagcctacactcacccatgtattaagcaaaggttagtacttgaatgatttgataccaggcatcgttcggcttcaaaataacattaaacttgcctcactacattcccgcccaacggcctgaagttgcttttgagtatcctgtcgatccttttccagtgtcaaagccaggcattcaagccgccagtagttttcttcgatggcagacctcgcagtggcactcgttgccttgctctcgtctattattgattagtggacatacaagaagggctggtgagctggcggtattattgctgaagcagatgtgtactaagtattgctgcgtctgtagcaagacatgagggtgaaaatgtacgggtgtgcctcaaatgcagctacactacgctcttaccaatactcagttgcatcgcctctagctcctgctccatgctcttcatcgctcgagttgctcgatccatctttgagcgcgccttggcaagctcctcgcttacgtctgacacgttgagtccaatgccatgtctgagagagtcgtatttgtcctcatgcgcctggcctccaaacgatgagcgccgggcgagggagtgatgaccttcaaattgacggtgataagaattgcttgtggcgctgtagccatatccagtgctgtcctcacgctcctctgccaaagagccgccgtattcgctccatcctctgcggctgtggtgtccatcctcgtcgtcgtcgtcgtctttatcgtcgttgtcgtcctcaaactctcgatagtcgtcccaatgaaaagacacgggccgtggtgatatccctgagattgagcctgcggtcgagtgggaccctgcggtggttggagaggctagtgagcccaggactggcacattgggaatctcgacttgatggggcagctgcaaatcattaggaggaaaagggaggtcatatggctgcagagtcgaggatgatgacgacgacgctgccattcggccctctatggtggacccgaaaccaaaactgtgctctgtcggtgacattggcggtgtcataaggtcaagggcgtccccactctcatgacatgctcctcgctggtctcgggctgacgggagtggagggggtataaagtacggcatcatgcctgtcgagaggcgagcggacacagacctttggttgctgctgttgctggcgctactgctactgctgctgttgctggtgtcgttgttgtggttgttgccgcgactgtcgctgctgtctctgccactgccattgctgttgctatagcttgcagactatcaacgagacaccgcaaaaagcgcacagcgttaggtttttccgttgaagcgagaagagagggagagagacagtgagctaaacaacttccaggagacgctgagcagttactgacctttccatgggacccaagcatcttggaataaggcgaaagtgagcaagtgtcaaggcaacagggagagcgttcagaaaaggtgggatagagtgtaccagaaaatcgcagaaggctgccttaatggatgctttctatcggttcagggacagtggttccctaaggatcatgtctcctggaagcagtaaacgggaggcaacagcaagcgttgcgaagaatgtgccgcggggatgagagaggggaatatctttgcggcggtgaaaagtggagaaaagggaagaaccaaggagaatagcgtcttggttgaaggctgagggagcgaggtggactgagaacaaaagtaaaaagaaaggaggtccacagggagcagatctaaaagagcgtcatcgagaacggtccttctgaccaggtggcaaggcactcttgacctcggggcgctgtactacaggactgtatgtttagccacgagagaagtttgttgaacgcgaccagaacaaggggtggaaagagtgagtgggcgggtgagtgcgggcgtgggtcggcgagtgagtcctttgaatggagtgcgagagagagagcgagcgaccgttgggagttcaggggtggacaagagcgatgtggattatggaacctgtcgaaattcggaatcggaatcgggagcaaaggagtgcgaatccaatggaagcagagcgtcatttttatgttgttgatttcctcctgctcttcccaggctgcgggattgcctccgcgctgcgtccatgatttttttccccatctgagatcgaggcgctgatccaaaaccgaccgcctggctgacacatagaggtgcccatggtcatcttttgcacggggtgcatggggactagtgcatatgggttaagacagatgtgcacgaccgcagacggctggcgggcgacccctggtccattgaagttgatcgaccgatcggctgactgggtccagcagctggcttggggtacatgtatatggacacgcaggcgtggcctgtatggctgcaaagcacggtcgacgcgaaacgagaaaaggcgcgtgctgtaggtaggttcgtgttcgtgcctgcttttggaaggaatttgcagtgtggtggatgcccagccagtcaatgtcgcgatcaccctgcgctgattcccaccacccctgcgtctgataggccaagttcccaccaccctccctgtgccccccccccctgtccgcccggttcacgctctctttcctcgtctctttgttccctgtcctcctctccccacctctcctctccatttccaagctcatccacacccaccgcctgctcattcgcacactcccgtgccctctcccttgcctcctgtcgctcccccagccttgactgatccgtcgtccccattgctgtgcacaccacggtcatgcgcacctgtctcttcctgtccagtgccatcgcactcgtggccctagccaccctcatcccctcctcgtctgcagcgaccactgactcgttcacctacctcaacgacgagcgccatctcgacggatactttgctctggtggagcgtgtaacaggctcgacgggaatccgtcactgcaccgtcgtggaccaaggcctctcccaagcgttcagaaacctgtaccctgtgaacaagcaaggccagagagcccagattatacaccgcagcacgcacgacgagggccaccaccacggcgccgcttcggtggatgaagaaaaggacctgctggaaatcaacaccaacctactggagcacaagactcagatcgttgaagcttttttcgacgccgagtgcgatagcctcaaagatgcccatccactgggtccgtactcccagggaggccaggatgtcctgcaagcgcctgaacgtctgcaggagggcgacgaagtggtaagaggtcagagacgtctgcttttgagagctcggtttgcttcctggtttctcacgctctgcttcacctttttgacacgtagcgcaagctcgtcgacagcgggcccgactctaaccgcgtggatattgtcttcatgggtgacggatatacacttgaggaacgcgaaaagttttttggcgacatcaagcgtcttgtcaatggtatgttactttactactcttcagccataggattcatgtcatcagttgtctcccaatgtcactgactcctgtcatcatctgcctcacggtctccgcctacagacatgtttatgggagacactttccagtcgttcctacccctgttcaatgtccacgcgcttttcaggccatccaaggaaagcggcatcggtactaacggtcgctggaaggacaccagcttccgtttatacagagacggcaccgagctccgcggcatctatactgcggaccctggtgcagcgcgtcaggcttgccgcgcagttgggaaatatgcctgcgactttccgagcttgattggaaacgacccttactgtaagaacgcatacttcatacgcggatactgtgcaggataatgcgtccggcaaacgactcacatctctatggcatattcatgtacgctgtagatggaggtcttggtggtgagtttgtcatctcgacgagctccaacaagtctggcaccattgtccttcgccatgagctcggccatagtcttattgacgttggtgaggaatacgatggcggccaagtgtactctggtgtgaatgctgagcgctggagcatccaaaacatcaagtggaagcattggctcaccgacaaggttcctcgcgaagagaagaacgtacttcgagctcaagactacgcgtggtatgatctcaagaagggcgcatacaaggtcaagtttaactctgacggacaatggaaacgttggagcctgaagatttcgcattctggcgttgacactgacgactccctggaggtctatatcgacggcaaaaaactcgactgggtgtctcctggtggatacgatcgtgatttctcagaatggaacggcgatgagggctttagtgctgggtcccacgagatcatcttcaaacaaggtgcaaaacatgacggtgagcctgccgactctgcaagacccattcgacagctctgctctgtgacgttgcacgaattcatgggtgaggacgagtatcgattcgataacaacatcatctctgcgtacccgacctatgacatcaagggacgcaagacctggcgaagcaacaacgaacgctgcctgatgcgtaacatggcctcgacgcacttttgttcaatctgcaaggaaggtctctggcacaggttgttgagcaaggccagtttgttggatgacattcgcgttgtctgccagcgcaagaacggtaacgagggcgatgtgacatcgtttggaattgaggccaagctcattcccttgggtcagttcagagaagaccagtccaagcgcgccgcggacgagtcctacaccacccgctggctccttaacggcgttcctcaagaacaatatgataaccaagtcaaaatccagatcccagtttcggaggaaggcacttgggagttcaagaccgagttcacgacgtcggaagttcgaaaggatccgagtgggctgctgaaggccagcagagtgtttactgtggcccagcgactgtgctaagtgagctcaatgaacaacaggccatctgatggcagagctagtatggctggtgccaacccggagacacgtgtaataaaaggaggataagtcaggtcaggtcattccaccaacgtggctacgcctaatatggtctgaaaacatcctgtttaggatgtttgctcgattaagagaagcagcttctgacgaggccggaagaaagataaccttggcaacaagaaccgggtccttcaccaccgagcgggcgcggaacaagaacgtaagcctgggccaggcgagaggtggtacctcctacctcatgcagatccccttcgcaccatcgtgtttgctcccccacccttcttcgccccccttttttttacaacataaaagccctccccggttgtgtcgtggcatctacggccattccctgtggcgaaccccttccatctatttcaaggctagggcaagggcgacagttttgcaggagttgaggagacgagagccttccccagatgtccagtcatccattgcgcgagccgatactcactggcctcccgtttctatataagctgcaccatcacccagcatctcctctctagttctcttcacatcgaccagtctgcctctgatatctctctgtacacgatcccacatccgtcgtctatcactaactccaacttcaccccacgcacgatatgaagtcctcaatccttgcatttgtagccgttgccgtcgccatggcagctcaagctgacgcccaggcattcaccccggatgcctgctctgcatgcacgttctcgtctgttcctaaagagcccaagtgtgcaagcttgaccccggaagaggcaggcactcttatgaatgccttcgccaactctatcgtcaatgtgacggcacttgcgatagctgtcacggatcctgaaatccacgcatgtgtgtgcaactggggcaccaacactttcaacaccacaggcgccgcgtccttttgcgcgatcaagcaaggtggtgagaccgcaccagcctgtagcgcggaacaggttttggaagcgacgacaaagatggccccgttggcccagatgctgcagtgccccagcgccaacagcaccaacacaacggctggacctcccggcggcgcaggtgcccccggtacccctggcgccccaacatcgacaaagccgagcgctgcatcgtccatgattttcaacgtgccctacgtcgccatgacagtcgcctttggcctcgcggcgtttgctggtctctaaccgtgtccttcagtcactatataaataaatatctaatgaaacttcgcgtgcgcgtgctctgtgcaccctgtacctggcaaaaggagcgatgaagctcaagagacgttcgatgaagacggctgaaggtgtgcctcgggtggccgtcgggctgcagtgcggtagctttgtctgcgcaggctatcctagcgagaagcgacaatgcccctttttttccttctgacttggtcatttgtttgatgctaagagagaaaaaaggtcctctccagcgaccccttttgtctccgctctttcatccgtccctcacctgtccgaccctcttgcctcttgccctcttgacgcttgactcattcctattcgcctttgcttgatcccaaactgattcccattcccattccggattcaaccacagaggacatcgcgctctacacagaccaagaaccagcgaaggaagaagaagaaaaaaaatatgctttccgggaggtcggctgcagagagggcagaacgtcgagcggccaagacacagtcgctctatgtcgcaactccgtcttcctttggcagcaacacgtcttcgtcctttctacaccagcagcagcaacaacaacaacagcagcagcagcatcagcaatctcctggatacggacagtcaaagtcggcgtttcttcctcaccacaacgattccagtaacaacaggccaagcaagtcgcccaagaagactaggccattttcgatgatgctcctccactcacaggacgatcctagcagacaacgacacgagggttatcctgcagaacacctgcagcagcagcagctacaccaaccgttgaatgagtcggacgaggatgcagttgcggatggacattcactaacgtcgacgatcgaatatggcgacagtgatctgaaggatgtggatgccaacacgcagatgctgatcgcgcatctcacagacctcgatgtaagtccgcagtccgtgctgacaccccttgttacccaccagcccccccccccctggttccacgcgatcacgcgccacatttgagagcttccgtccctgaagcggggctcgcgttgggggcagacggtttgcacctctcctgctgtcctgtgagacgactccatctcacgcacaaccttaattgtccaacaacttagtcaggattgccgatcttgctggaacgagtcaaacagaatctgcactcttgcaaagtgagtattaccaagacgtgggggagacgaagagacgcttggtcttgcttctcaactttcttgttgcatggaagctccccccatctcatgcgcatggatatcgtatcatccttgttcttaggacatggtctcgtttctgaaaaagcgatccgtcatggaagcagagtacggaaccaacatcctgaagttggcctccacgttacgagacacctatcgtcagcaaccagacggtcctgacagtcaggcgcattacaagcagggatcctatggcgactgctggtcgcatatcttggaaatgcatgaacgcatgggcaacaaccgactcgagttctcaagggatctgcaagtcgtgtcagaagaactgtcgacgatatacaaggaaacagatcgcagccgcaaacaggtagctgaatgaccctggaggttggaggttggctatggacggatgaaaaacgttcaagttggtaacagcgatgctcctcccttcaccactccgtctgcttagttcaaggaggcgggagccaagcaagaaagaactgtccaggagcatgagcagagtctcgaaaaggtacaggaactacgacaactagtaaacgtgataacgcgtttctgcttttgcaaaaaattcagcattcaactgacacagtgctccaccatgtttcaggcaaagctcaagtacgagtcgcttacggaggagtgggagcgagccattcttcagaaagcagctgacccgtctgcgcagaaaaagacgatgaccaagggcatgaccatgagtattttccgccaaccgaaatccatgggacaggtgagttcttgttgcatatcggacagcgtccctctttgtgtatggccggcagctcaactgacatcataatcacttttatttgggcttcatagctgcatcggcaagaggaggaggcgagaacgaaagccatggctgcacaggaacagtacaagtcccagctcgcgcggacaaacgacatgaggcagtactactatgctcacacgctgccaagcatcttgaaggtgaggatggcaggaagtgcatctttgaagtccgcgcgtctctgagaaaataaggcagctgatatttgggttgtctgtggttgttattctagagtctcaaagacaccatagatgagtcggacttgtcgctgcagtactatttgatgcgctacggatacatgtatgaggactacatgatgaaggacgcgatcgtcctaaaccctatcaatggttcggatttgggcttgcgcgaccgcgtggagttgatcaacaaggacacagatctgcaagtctttgtggaagcatacgcggccaaggctggtcctgtggccaaggacgctgcgccatatgaggagtatctcatggtaggtgcccttttgttacagcagtatcggttccagtccgtcgcgtcaaagcactctgtcttgatgaacagaggctcattcatgaattctatgactatagtcggcgcaagcgcagtcaatcatcaatccgcggccgatctttggctgcgatcttgcagagcagctgatccgggatgaggcggacctgcctgaaatcgtcgtcaaatgtacagaggcgatagagcgctacggtacgacaattactttgcatttgtggtacgcgtgcgattttcctgcagggccgtcacgctaaatctttacatgggtcttggacaccatagggatggatactcagggaatataccgtgtctctggtattacatcggctacgaaccggttgcgatccgcgttcgacagaggtatacgctgaatcttagcgctgggaatggagtttgtctcatgacgactggatgcgaacactaacagcgacccctgttacttgtcttgaagactgctcttctgtggatttggatagcgaaacaaacgtcggtgatgtgaacagcgttgccagtgtcctaaagtcctggttccgagagctgccagagccactattgacacgacggctctatccagactttatcaaggcggccagcattgaggatccagcacttcagctgatgaatcttcaccaggtcaccaaccagttaccggatcccaactacgcgacgctcaagttcctgatgtgccatcttaatcggtaagaagggtagttttcagtagacttaacagctgtcgcgatacgatagtgatcttggaatcgaaggtcggtctgctctaacaaaaaaccttttaacggccctcctttcttgtttttagtgttcaagccaatcaggcggtgaacaaaatgggcgcctcgaatctggggttgatctttggaccgaccctcacaagcaccagtggaggggcgggcgatgctgtcaacgatctggcagacatgggtcttcagtgtagggtgattgaaaccttgctgaacaactatggagcgatctttgatatcgaggaggacgaaaatgagggacatggagaagaagatcagccactgcatgaacaggatcgggaacaggatgagcatggctacaaccactacggccgtggagagatgcaacccattcacgaggagtatgggtcttacattcagccacctgctggatattcggggacgatggcgggacttcccgaagagcacgaggatagtgatgtgagtgaccgacggtatgccatctacagtcttcaggacccgcagcaacaggaacaagaggagagcgtagccgcagagaatagaaggagcacgttcgaggaagattttggagagagggttgtgccggtcatggaagacgaaggagaggtggaggaggggacgacggaggaggaagccatggttcagggtgtaggccatgatgatctggatacccaaaaatcatagcggctccagtttgattcttagaaagctttcatcatccgttgattaaatagtgagcggcatcgtacggacccgatagttcaagtctaatagccaatggagaaggcgaggaggccacagagggacatgtgcttggctaagctttatagcaatgtgtgtggaagtgcttgtgtaggtcagctctcgagaaagagggttcggcgggggcggtcgcatgcagcgaaaatgtcttggagcttggagggtttgcggagcaaggccgctcgacggtatgctttgcacccgcgtccttgcaggatcgcgcatccccgtgccgctattttacacgctctccattaaatcactccatctgaggtctgctccccccccaaaaaaaagtaccgatgcttttagtcgctccctgcatggtcgagaaattgtcatggtagacgcgcattagaccgcaagtctatgcagttcagatggtcgtccccagaaatgctcatcccttgacttgtctctatcgctgccctgtcttgtctgcatgcacccccttttcgccgaatagcaccgtgtgtcacgacagcggggctaagagtcaaatatggctacgcgcgtctggcttcgcaaatggcatataaagtatcgtcctacggaattccatccaccagctgaaacaaccctctatgcttcgtccgcctattgacgctcaaatacaccctgtctagatgcgaatttactctgccttttttcttttcacgttctatggcttggcttccggtcatccgcttcgtgaaagcgtgggcgtgagttcttgcaaaggaactcagtcgttttgtacgggtcaaggatttatgacatgcattgaaggaggttacgcttattaagattgtggaccagcaacatattgtcagcagaagtcggcgggtatagtcagttgtgaatattgagctcgtaagctgtaactattcagccatgctatcgatatgccccaatgcaattggtctgacctctcacggtctgcattcgggcggtaaccattgattcaaagggagcagatacgatttcctccccctacgcggtgaccaggaacagagggctggaagtgctttacgacgagttcgataatgacactcctcacggttatgaagcttcgtccagcgttaaattgggaggctgtgatcgcgaacactgagctcaaccaacgttggctatatgaatatgccatgacgaggcacagaatcctgcgaatctgataaaaagcaccgccctctggatcagcagccgcggccaggagataacatgccatttttgcatcctgcatcctgtatctccagtggcctttgatcgaatatatgaaccaagcagagattgcggccaagagactcttctggctgaaacggtgaaggcaaatgcgaggctcgtgaagctgcagaagtaggcaattttcgcagcgttcggcaaagcgaaccagacctagaagaaagcatctttttgagattgctcgttgaagtatacgcgaatgcccatcggtgaagtcagatgctgtagaacgacgcgaacagtgtttatagttctccatctgttatggtacaactgagctccagctggctgcttcccgctgttgccctgtgagtgatttaaccttcctccttgtcggcgagtttggtgacgctcatgacagcgcctctatcggtccaccggatggtcctggcacagagtcgccatagcacacctgctctagctcccatatcgtccgatcgacctcttccttgagtcccagaaccctctgcttcacggcagtcttttgtgtcgaaaggtccctgtgtcgctgcatcgatagctgcgccaacgtactggtgtcgttcaaaagcaacgtctgtttcagttccgtcaccatggctagcaaagactctgctgaggaaacgatattggtggcacgagcctgaatctggtaggactcctgcgctagtttgtacttgtccttggagaaggatgaatccgtgtgcgcgatctatcgatatagccgaaggttaacgccatagtttagacatcctgttctcatgtcgctttcggagccttcttcgtgcaaacgtgatacattctagcactttaccgaagcaactttgacgatatcgccaaaggactccatgagttgggccacatccatgtccaaccgcttgttgtaggtttcctcgatctcctggagtgccgtgagaccagcgcttttggccccagctgctcctgctcctgctgctcctgctccagcggcggtagctccaccgacctgaatacctgctgcagcaccagggacagagcctgctgggacgcctcctgcgccagccattagcggcgctgagcccatgggtcgcgacgccatcgtggtagttgattcaaaaaattcaagttttctcgcgatgagtatgctgagagggagagggaatgttcaatggcccttttgccttcagggtcccagggttctcgttgtcgcttggttctgctccgtgagtgacgggaaggatgagtaaagttcatgaggaacgcgcaaatgagcgtcgaaagtactggtggcgagcaaagccacattagacttttttttttatattatactcatgttgaggcggtttgcattcacatcacacacaacgcccagcctgggatgatgcaccgaagtgaggacctgtcctttacaagagacagtgctcctttatgacggtgagcattaagtaggctttcatgacaagggccagatcaaatcgataaaggggactcgttcttgatgacaggggcggtttcttatgacgctttgttgctgtcaagatcctctccccctttgcgcatcgaaagtccagccttatcgagagacatggtgtatgaagcgagtttgcatccgagggtcctgcccaaggactcatgatgtacatcagatgtgttcacaccaacatctttcaacaccttcaagctacttgttttcaagtttataaaaggcctattgtctttctcatatctggcccataggcagctttggttcgatagcaatgctgcagaatagaatacaattgtcggctatatacaaagttgggcaccacaccgtctcctatccactgcccaagacaagagagacgagaagataaaggagagaaacgcgctcagtccaacatctgaccattgaggatcatgctcctcatggggctgctcgagcgcgagttcttgtccggttgcgatggcttcaaggcatcaacggcggcatgcggcaggtgcttctcaatgtggctgccctcgctaacgttcgaaagtggaccgattccaggctgctgctgcgaggaagggccaaattcatttccgtccactatatgctgggctggtccagacctgccgctgactgaaaatttgcgaagaaggcccccgagaccaccctgggttctattcgcagtagcagcctgctcagatacttgaccgttgctggtagggtgccgtgagagcggtggtgaggtggcaaagaggcttgatcttcgacctctttcctctgcctgtgggtgtgcatttcatgcatcaagcgagaagtacacaaattccgttagagatagtgagcgaagggggttgtagtctggttcaaactgtagagccctgcacgcattgcatgaagcgccatttgtgctatcactacgctaacttgcctgggattggacggtattttgaccagctggatggttattcaaagggtttgtgaagctgctggagaagcgtctgttgaatgaagaggggatgctgctggagagaccagcaaagttggtgggcggcgaggtgctgaaggaggcgttggaaggggccgcactggtggagggcgaaacaatcgggttcaagaacgggttgttggggttaactgcagaggatcccccaaaggcgatcggcgaggtggcgagaccgaaggacgtggacatggagcgctgccgtgggatagagatcgacaatggcaccgctcccggaccagccgactggtcagcgccggctttggaagacgaggaatcgacgccgacgccgaacacgttggagatggaggaggtggacttggatcgctggtgagacatgtttggtatggaggaaagaggacggtgggtgaacgttacgatacgccgagagaaatatgaaggtatacgagcgatatcacgatgcagctatgacgagcgtaacgaacgcagcgggagcaaaggccaccaacaaaaagaaaagagaagaggaaaagagaaaaaggatgattcagaggagcgaaggagagtgcgggtcggaaggtgggagcgggggaaggaagaaagaggcgaggcggacactggtgcagaccagtggcgaccaagtgcacaagagcaggtgcaggtaggtggagacagaacagagcagcagtcaacagcgcccagagcgaccagagcggccagagcgagagcgaacttttttgcataaacgctgatcattcggccgtcaggtgacagctgcactgggcgacactcgcggcgcacgcgccccacaggttgccgcctctgggcgccagatagctgctggatgacatatgattgtccaaggacggtgatcaccaaccagctcgctccgagccatcctcatcgcccatggacgctcgtgggcatagtgcgcagagcggtagagggcacgtcatttttttcgttttctctctttttttttttttttttttttttttacagagtgtgtgagttgaagactgatgcgctttctttttttgcttttttcgtcttgatctgattgtcctgctttttcttttgtcgtcttccatcgagctgaccagccctgcgtcccatccattcccgctgcccagtctccccgcatctctctttctctccctgtcactttctctctccactcacccagtcgcttgacccaccatcgcttttcagagtacctgtttgactcgcccctgtccattctcattcccgccagccctgcaactcggtcgcctccccactcttgcattttcgtcttcatttgctcgcaatcctcttctagaaccagaagcaaacgtgtcatcgggagactcagcacagcgacaattaactctacaaacgtccccccactgtacaatgtccgcccgtgaatggtgggcgatcaagctcaggtaataatctaaaactagttcagccgcgtgatcgggtccggaggttccaaaacacgcttgctccccgcagtcagacctacctcggttcaccaatggcaaaaagaaggtgtaggactgaagaagagcccctcgctggactctggtccccgttgacggttgaagaatgtcgagatttccaaaacgcaccactcttttgtgtgtgggggtgtgggtgtgtatgtgtgtttgagcgggaaagactgcaggtctcgacgctactttttttttcttgttgttcgtgtgaagcgtgtgaattctgcggatctcaaatgaaagttgcatacataccggcagggggcacacgacacggatactgtaaactggatactgcgacacgcgctaacaacccgagacggaaagggcctctgtatgagtgctgatgcaaaatgtcttcgcatacacgctgaactcgactgtgcttggtcagggactccaggacgagatattaatctggacgaagcacaaccgcatatcgccgtgctcagtggacacctctatctgagatgctgccatcagtgaggacgacagaatgtattactcttctcctccacgccgactcttcctccgtcactttccgtccttgattttctattcttttttggctagtaactgagcccttcctcatttctctctgccaacgccttgaccgttgctactgttcaaccaacggccacatcacatcgactatactttatagggaatcggatcaattaaaacacaccattgctggagcaggcgcgggactggtcacctccgtgttgacctgtccactggacgtggtcaagacaagactgcagaaccaaggcgtcgttgcctcaacaggaagatcatacaaaggcacagcaggtaaagaaaagggcgtcgtattctgttgattcgtactgtctctatgcgcgcgcactattctaagacaatcgtttatgctggcatctttaactaggcacgctcaccaggatttggtcagaggagggcgttagaggattgtacagaggactcggccccacgatatttggatacttgccaacatgggcgatttattttacggcatacgactattttaaagatctagtagcacgtcaaacaggtaaatgttgtacaatcattacggaactatccatgtcttgtacgccgacaacatacgaggagacaagtgcagtagtcaagcattgtcaaacagaaagtcatcgagccagagacgggataacgcgatatatactaatgccacgccccctattctcttgcatcgtttcactctggaattgctaggacaccatgagtccaacctgtttgtatatatcgttgcagcaatgtcagccggcgcaacaagcacgacgatcacgaacccgctgtgggttatcaaaacccgcttcatggtatgtgcagaatcgccgtgagttctattcaggtgatggctgctcaatatactgtcaacactaacgaaatgtttatattttggatagacacaaaatgaacataccccataccgatacaacaacacgctccatgcattcacgaccatttacagggtggaaggtcttcgtggattctacaaaggacttggatcctccttgatgggcatcagccacgtcgcccttcagttcccactctacgagaagctgaggctatggctcagtaagtcatgcatttagtgtgaacggactcgaacatatcgacggggaattattgacctgatatctggaccctgatctgatgatgcattgaatatttggaatgtgttcaatagaatcatcggactcggatcaagtgagcagcgccaacattctcgctgcatcatcgacctctaaaatggctgccagtattgccacttatccgcacgaggtgagaattaatggaatgattgatacaatcgtttcattgcagctgcgcctctagttgctcggacgaaaagtctcatggatctgctcttgttgaaaactaggtgattcggacacgcctgcagaaccaatccacccatccgccaaagtatcatggaatcattcatgcatgcaaagtgatctacaaagaggagggaattcgggctttctacaagggtatgcccacgaaccttctgaggacggttcctgcaagcgcactgacgatcctgacctacgagttacttgtgagccgattgaacgaaattgcagcaaagccagtatagacatcaagaaatatcaccgcgcctttgcgacagcgcctgcggcgtacctttgcgcaggggtgcaataaatctgccgacctcattgttgccaccaataattttttagaggcagtccacagtatgttttttgtaaccctttttctcgctctcgcttcaagctccaagcgacatccttcaacaactcaccagcacatcccaacaccttcgctcgtacagcctcagctcgcgcataatgtatggcgaagaggcttcaaaactggcgcgagagaccaaacggacagtggatcacttcccgccttacaacgacccgttagtgcgatccatcacacgcgagattcggcatctgcacgaaacttgtcaagctctcatccgcgactatggtctccagaagcagcaagtcgagcacgagtttgagctgaaatggcagcaattaaacgaaccttcgtcatcctcagcaggacgtgattcatctttacggggcgacctggacatcaacctcgattccaaccacaccacaccgtccatgctcgaggacaaccttcaccacccccacaacaacaagagcagcaactttgaatccggttcttcctcggccacactcccaacctcacaagtctcacggttacatccaccagacctgcaagctcagaagcaggaggccctacagtccataacggaggttttttggacaaagtacctcgttcaccagaccccgctcctgcgtaacaaacggatcctcatgacctaccatcaccagcgtctggaaaagatcaaggagttggcttggtcttacaacacactaccagagacctcgcggcggttactctctccggacgaaatcgtgttcttcaacgaatatgagcgacaatgtcggaacaagtactttgcaagtgatatcatgtttggcgacattgatctcggtttgggcatgatctcaccgcccaaggaggtctttatcactgtcagggtcatgaaggactgtggcgatattgtgacagagtctggcgcgaccttgagtctgaagaagaactcggagcattttgtacggagaggagatgtggagagattgatcacgcaaggatacttgcttcacgttgcatagatgaattgagtaaagaaaaaaaaagcctaataatgacgcggagactttcgttgctattcgatccgaggaggaggaggggtttgttgggctttatacgtattaaggctaatatcatacagggcgagggcaaacatatacgacttcaagatcagagcaccagcaacctgcttggaaatgttctttttgatgaaatgaagaggtgtgcgatttacaaactatacaactcataccgaaacaggaagaggctgcgctcttgatcatgcctcgatcctgggacgctttccagagggttgatcctcgatcatgtcctcccgatcctcatcatccggctctgtctttggtgaatctgagctatcagtctcgatcttctttcctgatttccgcagcattgcaatctgacgctgtacattcttgagctccaactccaaccgaatcttttctgatcgctttgcttcgagcactagatatacgtttttttttatggaacggacaagaagagtcagtatgaagtacgcagcagtagacgagacctacattccaggaaccgcgtgtggccctcatggatccgtttcagatggctgaacatacatagttgaggctgaaggagttggatgagagggttatagacgtcagtaagcagatcgtaatttggttttgactcttgtggatagtgtcaaaacttctccaacgaacttacgtcttcaggcaatggcaactcgatcatggtccattcttcttccgtgagttcatactgttccttgttttctgccactcgacgccgaatctcttctcttgaaagtttagctcctgtattgacaatacatccgttcttgcggcgaatatgttctccttggatcagtgagttcttttgtccaatgactcttggatcaatatgcaatcccgcaaattctagaggcgcagagtccacagttaactttagtcaatattcgtcaagctcgctgctaacatggttttcatggtgacattagtgttgttgttgttttttacctgcggtactctgttgacccagcatgcgctgagtctgcaggttcatttgagcattcgtctttccgacaagacagttggactcgataatctttgaccagtttccaatgccgaacttcatgagagctttccgcaagacctcggcttcattcatgctccatcctttttttttcaacaaaaagattgttctcagtgttagcaaatactgtctttggtgctccaaggatgcccctgctgtggaagacgacctttttttccccacgaactggcgcaccaagctcacactctttctttatcctctgcttcctcggtttcccttaccaggggcgactgtgtagttccagagagatgccgagtcgttagaacgcaggatgttgcgcgctcctgcagtcatggaacgaggtgttgatgaggacattatgagacgaggtttgttgttgtgaaattgtgagacgagaggccaatgtggagaagaagagaaagagtcgaggacacgcgaggaacgcaaggagaaaacacaaaaaaatagtcaggcaccacgacgcgttccacagaaacaaaacaagccacggtgtgcaaattaaaaaaaaaaatgaaaacgcgactgcccaaagcgtcgctatcctgccgcacgagggcacccaacaccctcaccctgaatgctgggagaatggacgatacgtgcccaccatgtcaatgctccgtgtcaaggacggacaaccactgcatgaaatcgaatcgatgtttctgacaatacaccggatcacaacctttgaaatactccgtcatgactaagatctgcaagacgaagtgcgactcgatgaaccgcatgaggatcggtcccccacgataacaacgatcctttctcttgactctggatggcttgtgaggatgtataacagaaacttgtcgggttctgcccacccgatggaccatagtatgcacgctatcgcaagggcacaaaatcagtggaaaaaattggatgaagaaaacttgatttgctgatccgaaggaacaggcttgttgtagagatggtcaacaagcgacgtactgcagtgctgcactgcagcatacaaataggaactttgtgcgataggtacgcgacagccgaccaagtaccgtgcacgaggtggggtagagtggatcctaaacatgtgcatgtttcgagcacggtgttttttcaagcgatggctttgttgtcttctcgcaatgcaatagatccttgtccaatctacggaccatcatgataggcaacggcaattgctgctcggcaagctcaaagtgagcaatacactgaatcaaatagctgcaggctccaatgccctcacgaaggaaccgtcacgatgaatttcgtggacgtcctgatcgctgaacacgtatgaccagcaatgaccgagctggctgtggggaacccttttagcattttattggtctcggactgtagactagagttcggcgcgcgatgacaaatcgacggaccaaacagtgtagatggagggatgcggcacttgctcttgtccagagggccagagggacgctcgtgtgggttctgagggaaatggaaatggataaggatccacccacaccctatcgaacatgagagcagacccgcgaggctataaatacaaagggcggatcccgcctgccccacccagctcctgttgtcaaacgctgcctcgtatttctctgtcacttttatagtgctgtcatctgtcctcgccagcgcgccctcttcctctctctgctccctgattctcattcgtcttgctatctgacccagcccgctatctgcctcacaccccgcacacccctcacaccgctccgattctcatcctgtcacggccgctgagcagcaagtcgagcctgaaccagaggctgttttctttatctcttgtgtgctttgcccatcatgacccccttctccgatagccctccctcctccccttgtctctctgcctgctcgaccacctcctccgcctcttcgtccctccactcctccaccaccaacaccaccctcgtctctgccccaaccgctgcccctgcccctcgatcggccctacctccacctctacctctcacagccacctgcgcagaaacagagacaccggctcctcctgcacaggccacaagaatgaactctttgccagggatgacaggcccgctcattggaaatggccctggctacaagaacggcgaggccattgccttgcccattctccccacattcaacaaaaggctctctctgcacgataagagccggccctctccgacttcacccacgcatgcgggccatgtcgtctccaacggggacactcgtccgttacagcatgtggagacagctgcccattcttcatcacaccagctggagcagaatcattcttgcaacaacacaaagggactttcggcagcaggtcatgcggcagtgaatgcagtctctggctccactcaggcaacagcctgctcagctcagacacgaggcggcgcagacgccggtatcttggtcttttctggaggaacggcttgcaactcactggttcagctcctgcaggacatgacgcccaatgtcacctacgtctgtaagtcgtcctaccctgttatctatgatatcttttttttttttgtttttttttgcaggacgtgcagctcgctagtatgcatgaggcgccttgtactctggttcagtgtaatcggtgcaacgatgatttttttccttcttacccggagtgttgtttcgtttgagtcacagtccaatgtggggtcgaaacacactgagcggcaaatcataaagtgctctcgtttccctgcattgatcagaagcactggacgcacatagaggagaggcttaaaccaaagaaaaatgccgcacgcaaccgacaaaaggatattaaatgcctcgctcttgtgccactgcagtaggaatctctgacaacggaggctcgacgagcgaaattttgcgcgtgctcgacgggccagccatcggcgatattcgctcacgactgattcggttaatcaagccagatcctttggatgtcggcagaaaggctatccaggaactgctgggctaccgtctgccagggcatggggacgaaaatgcgatcaagaacgagtgggtcgagattgtagaagggagccatcggtaggtgatcggagccccttacgtgatacgaacgggattttaggcccacgtttattgacttccaatctcatgccttgcatatctctaggttgtggatgcacatcccctcggaaaaaaaggaagtcattcgaggattcctcatctatatccagtccgagatcttgaagcgggcccacaagcgtttctcttttgccaatggatcgatcggcaactttttcttgacaggagcgcgtatgttttttggatctctggaatcagccattttcttgtttgcagccatcaccggcatcaccgagccaacacgagtcatccctgtcatcaacaccaaccacggcatcgccattgcagcgcttctcaagaatggaaacacgatcttgggccaatgtgccatatcgcatccttccctcgcagcgttgggagacagtttcagtggcggacacgtaaatccgagcgcagcttcggcctccacgacaccggatgggtccaagactcctgatctgcaagtgatgctctcttcatcacaacatcaggaggatagcttttcgaccctgaagctgattcagaacaacattcattttgacaagagtcccacccagacgagttcacttcagtcgcggataaccaagctgtattacatcaacgagtacggtcaggagatctttcctcctcccaacccgaagcttctgtgctctctagcagaaatggagacgctggtctattccattggatcactctacacgtccatcataccttgcctgatccttaaggacgttggccgaggcattgccgaatctcgatcgctcaagaacaagatcttcatgttgaatggaacgaacgacagggaaacgcctgactataccgcattggatttcatccgagccctgtcggacgccctcaactcgtcgctcaagctttctggacaattctggccaaaggagtacaagccctcaaagtatatcacccatcttatctatctagacaactctgaggttcaagtcgatacctggggcgtagaaaagctggggatcgagtgtgtgccctgtgtcggacgacaggatccgtcttcgaaccggcccatctatgacgagtctgagctgaacaagacgattgaggctatcctggacggtacctggtcgacctctgcagcgttctcgtcctcctcgaccaccgccaactctacacgaccctcgactccgatcccgatcccgtcctctaccacaaaagcaaatgcagcagctgctccatgttcaagtcaccagattggcgtatagtccaaatgctctttcttcaatacatactgctcccctttgtatcgttcatttcttcatcatcgtcattgtaaacaatcttttcttcgccagcgaaaaaaaaaagtatcgtggttcgctttatttttcgattctctatgtgtgtaaaaaaaaaaagaaggtttttttttgacgagttttctccgcaccctggggcagcagtaagcccaagagtgcaagaacggccaaccccccaacggtcgtccttcgttcccatattctataaatttcttgctgggaggacgatatgaacacatcttgttgcgatcatcagcacgagaccaatataatctccttgtgcggggagtgcgtgtggggcacaacgagagaaggggtgttacctcctcctccttagctcggccaccttctcggccttgaggaccgccaacttctcagcgtctgtcatatgggtctttttgtgtctcgtgacctgatcgggcctcgagaatctcttatcacatccaacaaacggacattgaaacggccgttcccctgtgtggacccgcagatgcttggtcagattcgacgattccgcaaaccacttgtcacagccctggaacttgcacttgaacggcttctcgcccgtatgaaccctccgatggatcgtcagcgcgcccgagatcgagaactgtcgcccacacccgggttcgtcacaccggaacggtttctcgcccgtatgggtccgcatgtgctgcgccatgatgttggcttccgaaaaccgcttctgacacacctggcactgaaatggcttgtcccctgtgtgggtctggatatgtcgcatggccttctgacgctgtccaaaccctcgaccacggcggtcgcagttgatccattcacaaacgtattcgctcttgcccatgccgatgtgctcgtcgctcagatggctcgtcaaggtatcgaacgacgggaaggctaggcggcagtcgccccagagacacgggtgatgatgactctgttgcagaagttgctcctgcataggcgtcaaggcagagctatgttgactaaagtagtgttgttgctgttgatgctgatgctgtggatgctgctgttgctgttgctgctgaaggtggtgttggggcaacaacagcgaatgggattcctcttcttgcttgatcgttacaaaggggctcgtctcgggcgaggaagtaccccaggcggccctctcatgatgtgcatctcctagaatgccggttggacttgaaagaccggacagactcatgtggggcatttctgcggtcaagatagatcctgagacggaacccgtggtggaggagacggaggagtatgaatgccgatgctgtgacatcactacgggatgctgctgctctaaatgatgataatgatggcgctgcaaatgttgctgctgctgttgctgtttctgctgctgttcttgataaggagggtactggaacgaacgtggggttggagtttgctgagggtgtgggtgcccatgcagatgctggtgttgtatagactggggcgagtgtggcgtgtttgtaggtatcatttgtgaccaggacggcgtagttgggggtataatgtgatgctccatccgcaggtgccacaagaggtcatcgtggttaggctgttgggcgaggcacgattcccattgacacagcgtgggaaaacaaatttcctgcagggacacatgcagctcggacaagtgcgaccacagttctgctggggacacaaactcggcgctacaaccgtaccactggcatcggaccagcatatgaccttcgtccatcgaggatgaatcgggagacaggggcagaaaggacgaggacacggatgacctagagtggtgatgattcgatgacggacggtcttgtaatggatccctggcggaggaaggattgttcaggtacaaaggttgaaggacagggtgagaccgtgccgacacggggtgtgaaataggctgagatgaagcagaactcgacattccggcaattgctgcacaccccatcgtaacggccgggtctggccctatgttcgcgttcgctggacggtccataagcaccgcgctatcaaatctaaggcacccacaaaagggagggttgtgtaataaagtgaaaaggcaggacgaaaaaggaatggaggaaagaaagaaaaagtatattaattaaagagagcgatagaaaccaagagaaggagcaaaacgttttcttttccctttttcttcgttggcagagaggccaaaggctagcccggagaattttcggttttgttaattaacagggagtggagatccaaaaaaaaaaaatcgcaacgagcaacgggaagaaggtttgaggccaaaaagcttaaaacggtggaaagggacgagaaataagaaccctgaccaaaaactaattcgtcgacgagcgagagcagactttgcttgctgagcaaccaaggaaacgcaaaatgcaaaaaaaaaatatagggaaaacaagcacgaaaaacacagatgactaaagactaatcaaataggcttggaatgcgtatctgagcaggatatggccgcaagagtaccctgcccttcaagtccattttttgtcacttttggtcttttgctcgttgtgttcgttctgattgttttgttcatgagcacgtcaataaatctgcatatatgccacttacgctttgctcgtggaagatgaggagcaagggggcgatgttggggagcatcggaccccctgctgtgcctggaaaggagatgggggctcacagcccgacgaccggagacgagatgggttgcgagcatcatggccagtggaggctgatgtagcacagggggaaaatgacggtgagcagcactgcgtgtttgttggaagcgctgagatgtttgttgttggcggatggacagggtccatttcccatgtactcttttcagtacctgcgaggcatgaattttcgctcgcagacattggccgtgttccggatgtcgccatcgcaacgacctgccccgatgccactttggccgatccagctgctgctgctgctgcctcgtccattactgctgctgttgctgtcgcttcagctgatgctttggctgctgctgctgctgatgttgcaggtgcggtggcagtgggggccgtcggggcaggagagaaaggcgagtttgaggtggatgtatcttcgctgcgtcctccaaaatgcctcgtatcgatgcttgtggaacatgccgatgtgttgctcttgtctcgcccggataatggtgtagtgctacaggaccgagtatggccatatcctgaaaactgcgagaggactgtgcctggggggatcaggtcttgacaacacgtggagttcatgccctccttgatgacactctcaataatgcagcactcgatctctgccagtgacatgccttggatgagggccgtcggcacctggtcatcgctaggggtgggcgagctaggcccaggtgtgttgcaagtcgagtcggatacggatggtgttagccgtggggagcagcatgaggaggagaaaggggcaggagggcaggctgaggaagaagacggggggcagcaggaggaggagttggaggagttgggtggggataacatgttggcagtggaccagccgtcgtcgcagctgtagggtgggctggtgcagcaggcttcggctggtggtgttggaggtgcaatcaaagacgacgatggacggatggcaggctgctggtgtcgagatgaggcatgggcggatgcatccatgaagacagcacaaggatcagctgcaacgacggacgcccagcgaacgacagaggtggaatgagaaagagagtgtgagagtgagggtgcgagtgagagtgagaggcagaggacgggcagtcaggtcaggagggtagggcagcgagggatggggcgagtgtgtggcgggatgcaagatgcagggcagagtcaaggtcggatggatctgtgggtttggctgattaagcagaaagagagtggagcggatggtgttgggctaacaaaaaaaaaaaaacgaacaggccaaagacagcgagcgagacagacagcgacagagcgacgcaaaaatcagagacagagaagcgagatggacatacgcagatgccagaaaaatccttttccgctgaccactgggcccttcggggggcacttgcccagaaaggccacgggcgtctgcagtgcgcgctgttgtggccacccctggcctcgtcatggcccgtcgcacattggagggcgagtgcgccgcgtgtcggtgaggctgagatgatctgctgccacagaagacgaataaaaaaaaacgagcgagccagctgaattctcagcggctggctcgttgctcgctgactgggcctaaaaattgggtctggaacccgccatagcagaaatggaaatccagtctaaccgtttacagagtttagaaagagagccttccaaggaatacacggtgggggtatgtattggggcggacatatacggtcgtggcgatcacgaaggtcagtgcacccatggcattggctgcagcatgctcaagccaagtcagagtgcgattcaggcggacgagatggtagcaatgcccagcgtcgtggagaagaaatgaatgcagtagaaaaaaaagtgtgccgtcttcagaaccctggatcgacatcgggctcaatgcgtttatgtttgctattttacctgaaaggtacttttggattcatgatcgtcgaccgcagcatacttggagtgtctgaacgaaatagcgggctactttgtgcaacagtaggcacattctcgatcaaacacagcatggcgcacagcagcacagcgcgggagtacagagtcataacagcacgactatgcattagtttaagctacacatcaattcagtcccattagtctatggatttcctgcaggttggggcgcgcgatctctgaagctcgggctgcgccttgatcgagcaccgacttgatgtaggcatcttctcgctccaagcggactatttcctcctggatcggtctcagagatgtgaccaagacgtccgtcaaagcctctttgaagacggcattagatgaggttgcatgttcttggacgacatcctctaccgaaacgcgcttcatcgcagcgtatatatccaccaagttggccactgcgggtcgctcgacgcggtcgtacgagattcctcgtataccgtccgtaacggcacctttgatcttggccgagatcgcctcaggagagtctataagattgattctcgttctctccaacttgtcggatttggacatcttcttgcttgggtctttcaaagacataacccttttcgtttgtgctacagtgagacgaggtgatggtcagactaccatggcgctcttttcatcaaaaaggcatcctcccttcctcctgccaccgcatgattagtggcgggaacgtgggaatgaagtggctcgcttactgatcaagggctgtggaagagggaagaactgcttcttggcgttcttgttgaacatttgagcgatgtctcgtgtcagctccaagtgctggatctgatcctctccaaccggaaccttggtagctctatcaatgagaagtgagttagcaactgagctccaagttttgggcttacctttgagcaaagtccctgtgatcgtgatcattacttataaagtagaacatcggcggccatgagcacaggataggcaaacagccctaattggagtcctgccgtggcactgacatcttccaaacttgacacgccctttgtcaagccgagtttggactaggtgggcatgatacactgctgttaacaatgagattctgtttgagggtgtatctcgctgtgatctgacggcaaagctcggcagcataccttccactgagtcattcgtgcaagccaacctacaggggtcatgcagttcaggatccacgccaactctgcgtgcgctgaaacctatcctcgttaaagggtaccgttccgtcaacaaaagcacattcggatcaaacggtcaaatttcgagcgcgatgccctttaccttggactgttcaaaaaggatgcacttctttgggtcgattccacaggccaaaagtgtgatggctagttcgcgtctctcctttcggagctgatctgggttctgaggaagtgtaatcgcgtgtaggtccacgaccatgaacagaagagtctcgttatcaaggtgggcttgttcctgaagcgcaacccagttggaaatggcgccgaggtagttgcccaagtgtggctgtccagtgggctggatgccgctaagaataatgggctttggcttcgtttcggcccgaggctgcttgctggcgtgtggggtctgtgtagacaagtgacgggcgactgccagctggtgtggaaggtcgttagtgaacttgctgcaatggcaggatggtgccgcaggacgtgaatagaattgtgtccacagctccgagaagggccatcaccttgcagagcgaaccgccttgaaccctgccaagggaccgagcagttgagaggagtgatcttccagtgaagctcatcgggtcaagtcaagggggatgaatggttggaaggagcagcgggacaatatttacggtgcagtgactgtttctgagcaacctcttggagtcctgctttcatcctgcaactgtcgtgcattcttaccagagctgcaacctacgaagcaatgtccgcgttgacatcaataccctcgctcatgacaggagacgcacaggagacaggaccgacattccagccttcagacttttcgttcctgtcacaactgctccacattgttcaaaaaattgaatcaggcgaggacgctcaggagattgcgacccttgccaccaacctcaaaaacagcttcatcaaatgtcagacaatacttgaccatcttccaggagcggatctatctcccgctgagcaggccaaggttctagccgaggaaatgcaggtccttgagcggaaaaagtatgtgctcgacacgatgaatgtttgcaaaggcaaatgtcagcagagtcgacacagttatagttattagtactgacggagtgttgcttacaacatcctagggcacaactggcagaatatctctcatggcaggttttccagcatgatgcggcggaggtagcggtcaaacaggagatcaacgacaggagcatcgaagtcatgaaccttgactcgcatgcatcgagctcagcagcatcgatttcaccagaagcaatggagcctagctcatcaaatcatcaggtcgacaaggaggacgtgatcatggagacctttgatatggccacaataaagcacgaggctgcagatacaggatcctcactagaaccgcacgagtaaggattcgaaccgccacatttgcataccagcttgacgtctgaccttgatagtgtccaagtgcatggttacccagggaccccacggcaattctggctctcagggtccatagaataataaatcagctgactgacgcgcgtggtggctgacatattttgaatttcatttaagtcgcgtaacagtcctttttctgttttttgttttccttgccctgttaagctcaacgactctccttccgccatctctcgcccctcacgcacattccacacaatggtagagaaaaccgacacggatatcactacacctgcatgctcccgactacggacgcgaaaaaaactcacatcgcttctcgttctccataggctgatcgcaagcgcccccgcgatgacaacaatgtcaccacgccatcgtggaacaaccccgcaagctcgcccattctggcttcatcaccgcccctgccgtcttcagacccagaggacaatggagtgtttgacaacgagatgatttcagacctcgagggagaggacctggaaggagaaggcgaggacttatatggatcagatatggaaaagtaggtggccctggccttgctgtagtgctatatctgccccgcgacggagcactcacccgcaggcacccttgctttgttcatcttgtgtagtgactacgccgagaacgtgcgcctcgacaactatgaccccaatgatatcgatgacgaggattttgagcgcatggatcccgcagagcgtgcccaggttgaggctgttttggctcgacgagatgccgagcgtgctagggcagcaggcagaattcccgaagcattcttggatggtatgctaagcttatgttgccatcagaacacctgaacatgcataaaaggaaagccaaagccaacatgtttcaactctacctaccaacgcctaatagatgataacgacaccatcaatgttgtccaccgcaggagacgtgtccacgagcaggatctcatggatgacgatcttgaggatatggtacgcaataccgaaacggtctcagactttatagactgcagcctcacgttgcaggatgaacaacctagctcacttcactttttttatacttcaactctagtcaaatgtcatcttgagccctgaacaactgagcgatcacaaaggcatgtccatctccgagtgggtcaccaaggagctaacccgtcgcacaatcatgtcagagttcaggagattcttgttggagtatgtggacgccaacggagagtctgtatacggacccctgattcgatcactaggagaagctaacaaggagagtttggaagtttgttatcgccatctgtcagatgccaagcccacactcgcatacttcgtcgtcaacgcgccgcaggaagttctgaagatgtttgattctattgcattcgaggtcgtgcagatggaataccctgactatggacgcatccactccgagattcatgtccgtatcaccgaccttcccattgtgtccactcttcgtgaccttcgtcagatcaacttgaactgcttggtccaggtgacaggcgtggtgaccagaagaacaggagttttccctcagctcaagtacgtcaagtacgactgtgtgaaatgcggagccactcttggacccttctaccaggattcgcagacggagatctccattggaagctgtacctcatgcccctccaaaggacctttcaacgtcaactcggagcagactatctatcgtaactaccaaaagatgaccctacaggaatcaccaggcaccgtacccgccggtcgtctcccacgccaccgtgaagtcatcttgctgtgggatctaatcgacagcgccaagccaggcgaggaggtcgaaattaccggtgtctacaggaataactttgatgtagctctcaactcggccaacggattccccgtctttgccacaattctggaagccaattacgtcaacaagaagcaggacgtgtttgccagtttcaagctcacagaagaggaccgcaaggagatcttgcgtctcagcaaggatgaaaacattggaaagagggtatggctttcggtctgcaaaaagtgtactgggcaactgaagtggtgattgattattgtctaacaatgaacaagaacattttttggtttacgtcaacagattatcaagagcatcgcaccttcgatttacggacacgaggacatcaagaccgctattgccttgtctctctttggtggtgttcctaaggaccctcaaggaaagcatcgtcttcgtggcgacatcaatgttttgatgatgggagatccaggaaccgcaaaatcccagttcctaaagtacgtggaaaagactgcccacagagccgtgttcacgacgggtcagggagcctctgccgtcggtttgacggcctccgtccgaaaggaccctattacacgcgagtggactcttgagggaggagcattggttcttgctgacaagggcgtgtgcctgattgacgagtttgacaagatgaacgatgcggacagaaccagtattcacgaggctatggagcagcaaagtatctcgatttcaaaggctggtattgtcaccacactccaagcccgctgctctattctggcggcagccaaccctattcgcggacggtacaaccccgcggttacattctcggagaacgtcgagttgacagagcccattctctcacgtttcgatgttctctgcgtggtcaaggatacggttgaccccaccgtggatgagcgtcttgccaactttgtgctcaattctcaccttcggagccacccgcagttctcgcccgagctggatcagctcagcatttcagaaaagatcgacgaggatgtaagttctcaggacacagaactttgttgcaagtcgctggcaacccaggaatggtgctaactcgatgaacacttttctttacaacgtagattatcccgcaagacatgttgcgcaagtacatcatgtacgcccgggaccgcatccaccccaagattcaccaaatggaccaggacaagattgcgcgtctctatgctgacttgcgtcgcgagtccttggcaggaggctcgatccctattaccgtccgtcacctggaatcgatgattcgtatgtctgaagccaacgccaagatgcatctgcgcgaatatgcacgctcggacgatattgacatggccatccgagtcatgctcgagtcgttcttcagcgcacaaaagttctctgtgatgcgcaacctcaagaaggcgttcaacaagtacctgacgtttgccaaggatagcgatgagcttctgttctcgattctgaacgacattctccgcgaacacttgcggttcaatcagatcaagaatccacgtgcggcgatcaaggtgatcaagattgagctgagtgagctgaagaacagggcttcgcaggtcgatattcatgatattcagccattcctgacaagcaaactgttcacatcaagcggataccggatcgatactacgagtggtgctattgagaagcacttttaaaaaagtttgcatccgaaggcactggtgatatatttctactaatgaccctttttttcgctgtaataaaaaaaaactgagaagaaggtggatcaaacatcgaggctacaagacgctagtgacacaccgtatcctgcaagcagcgctgggtgacgctgtagcgcgcggccattcaacgacagcggcatatctgcttgctgcccttcttgctctgcggtcttccaagctagccacacggtcatctttttacggaagatgcatggccggaccttgactgtgaattgtaccttcctggcctcgtagcgaaaggattcgatctccatcgtgggcaggacacttccttccagtgtggcaatcaaatggacactcaactgctggtgtgagttgtgaggttggccagcaacgacgggcatcgatgctgcagcattgtccttgttggccagaggcctgactggagttacgttggtgcgcagcccgcaaaggcggccagcagaatcgaggacgcgcagaaacacgcatgtctcgcggggattgagggcataagcagcagcggcagatccgaaatgaccggtggtggcatgaaagtagaccgagggcgaggaggttgcgttaccgagactcgctccatgttcattcgtgtcggcagcatcgttctggttcgcgacgatcgcgtccatgacgcgcaagttggtactctgcctccttcctgagagattagtcaagacaatataagtgctcccaccccgttgactcgggtcatcatcttgggttgcgctggcctgcacctgaatggcatagagttccttcacttttggcaacggctgaaggaccctctcgatcatgagcagaggtgctggaacgtctggcgtcgaggaccaaggaaagaacgaccccaacaactgtctctgctccgaactcatcttttcaagatccaacgggtccgaacaaaaaactaagtgccccagcagatggttcagcagcatcagcgtgcgcctctccgtcatggtcagacccatattccagtcccgtatgaaaaacacatcggggtcattgccaaagaacctccctgagagagcccacctggccaaagtcgacgttagcgagttgaagcacgagatgtattcgcgatcatgaaagaagcgctgcatggtgtcccagcctgctccaacatcgcatccaatccggcaatagtccacgaccatgaagctggcaccaagcggtacgccacaaccgagaaggatggtgtcaggaccagcccacgtccgtaccatttgcatcgcctcccacatcagctgcgcgcgggtcttatggttgcgaggctgttgggctgccgcaaagagaaagtcaagcttgagcatcttgaatccccactcttgaaccacaatccgaaacacatttgcgagatgagcctggacctgtgggttctcgagatcaagggcgtacgcacccaccgtaaaggctgggtgcgcaagcatgaactctgaggaatcttgaaagccgaagctgcagcagcctaatcctggtagcttagctttggttccatgtcccttaagactgccaccgccatcgtcgtcgtggtcatcgcccgcgtcttggtcgtagtagtgcttccgaacaagccagtctgggtgctcttgaacgatacgagacttctttgaaaccaggaaaggagccagccatagccctgggatcaaccctttctcctgaatagccgaggcgataaaggccatccctcgagggaacttgtccttgttccagtccagccagtcgccgacgactgtatacccatcgtcgatctgaaagaccttggaaggccattggcagttaccatgttctcggtctgaatgaatgtccttgcctgagccggtgaggtgatgcaggttctcgagagcgatgtgttcgttgatgttttcgtagtgactgtaccatgaggtccagcccgagagctgatggtggagtgaggatcggatatgacggcgatcgctatagcatgtagcccattgagctgtatacgcatcccatacggtcgtatccttgtcaccccatgcaaaaaaagtcctcaaaaccagcttgtcgcgatgtgtccgtagctattcacatttcaaaagaaaaaaaaggcaggctaagtatagctggattgcatataagccatgcccctgcactagactcttaccgtttttccagcacagtcctggaggatagccagctgaccctgtggaacgtccatcaaaaagtatgtgtagcctgaatcctctgacaatgacccacacaacaccaactcctccgatttcggcagtccccttgcctgtgcatcctccaggccatcgttgctttggctcgaggtcatacttcgatttggatccgggcatttatctctgatcacggtcaccaggttcgaatggaccttacccttgtcgcctgcataatcaaagatgtgcatgtctgaggctagcccgagctgcgtgatctcatgatacagcccgttgaggttcacaaaggccgaggactcgtccgcacttgcgaaactggtgctccagctctggtatccatttgcgagtatggccttgccagtcaacgcgcatttgaagctggctcggagggatcgcaaggagatggcatgacctggtaaagttccagaaggcacagtcagatgaggaggggtcgcaggagcgatggggtcgagcgaaagttcgatcgtacggatgcagctccgagaggagaggttgttcagtgtgcttgttacgacaaggcggaaggggctagcaggtgccgagatgttggaggtgtcaatgttcacggctttgtagtcgttggcgccaagagtgagactttgcgcttgcaggtcgttgcgggtggaggtaaagtggagtgggctagtgtctgtgccaaagactatttccaccgtagccgactgctccgagagacgtgtataaatgtctttggaggtccagagaagagtactgtctagcgccatggtgatgtgggatgttttgcaagagaagcaatggtgccgatggggaacaaaactccgaatgaagggcacaaatgggtcagtgggagacgcgtgcacagacccgctgtgcggactgttcctgacgaatttctccataacattcttcagacgctgttggcccctctggaagttgctttttattattttatatcaaaggaacaagaggtattccagtcccaggctacaacgaagacatcgttgcagactactcaaacaacgctcaacaccaggagcgcacatcccccgttcaagtgaaaccaagaataaagagaaggaaaaaaaatgacaagatcaagagcgttcaagcctgaaggactacggtgaatggaaaagaaagaatacagccaaaaaaattagaaggaggtgatgcaagttggaccctcaaagaggttcctagaccatcgccgacttgtcttcgggatgcggctggttctcaacgttcagttcctcgttatccaccaggcgcttcctgaacttgggctctggcgcaggacggacgttgtagaggatgattccgagcatgatcaagacgtacgcaatagggtagatcttgttgatcgtggcattgaacaagaacagtccaaagagcagaccgtaaaagtcactcgtcaacaaactcaagttgaagaacgtcgccgagctcagacggaagaggatgggcgagaccgagtacaacgtgaacatggcaatgtcgaatccaatgatgtatccgatcaccgagggtgtccactcgatcgtctgcagctcctttctctccaggatcgcaagctggatgccgttgatgatcgttgcccagaatccgagctgacctacaacctcgtacatgggcctttgacggaccaggtactcttgaccaacgttggagagagcgtaaaaggtggcaccggcaatgcagaagagatctcctttgacgagatcagatcctggaaagtccttgccttcgaccatgtcagaccaaatcaagaaggccataccaaccatgcagacaaacactccgaggtagtgccagcgaacgaagcgcatcttgaggaagaacacagagagcaagaccacgcaagggatggtccaagcatccagcaacatggccgatagcagggacgtgtaggtgtatgccttgaccatgaagtagttgccctcgacgtcaatcaacgcaaagaggatgtctatgtcggtaagagaaaagtcgcaacaatggccgttagagacaaaaacgagagcagatggacagtcctccacatgtatgcttcagcaacagcaaacacagagtgcccgtgggatgttacttacagtagggcgagcggcgacgcatgatctcgagccatccggagaagcccttcttgtacagggtgatacccgtgtaaacgacaccgagcacaagatagttcaaaaacgactgtgaagtagggatcgagattggtgtctcgccctgcgccaacttggtcgtgaagatggtcgttgccgtgatgcacaaagcgaggacctggcccaacacgaggatcagcaagaaccgacgggtgaacaagttcgaggttcgctctttccaggtcaaaggggacgaagtggaggatgctccctgatcgtgctcgttgagctccatcttgccgaacgctacaggctcgttgagagtcttgtctgtcatttttttttctgttactcttatatgaggaatgaggaggagtgtgttgatgagacccttggttgccgagtgtgaatgcgactctgggtggatggattccgtcttttaggtgtaggaggggtgaaaagacgatgaaagcggcccactgatccaagatgcagaatcccctgcccttttatacatcggccagctccagctgagcaaagtaccactggcagtgcacatagaagaaaaaaaaaaaaaaaaaacttctatactccgattcgagggaaaaaaaacagcgtggaatcgaggtgaggctggtctgaaaatcaaactccgagttcccgatcgttcctgcacatgcttgtctactgaacaacgagcaggatgtcctggtccttttggttctcttccttgttctctctgcttgcaaggcacaatgcttcgcttggccctgtgatccttttgttgacaacaagtctatgcatcatgcacagtgcttctaagatgctggcgaaaaagagatgttcgggactactttagcccccaaggcaataaacatctagactccgcgtctacgctcagatcgcatctctctttctgtatttcgctagccaagttgttgacaaacctaacggggttcatagtccttgtgggacgaatccgcctcttttagatcaaagcgcttcgctcagaagagccgaataaagacatccacatcatatgcaggtcatactcgtgccgcaactgaccttggttactacaagcgcaaaactttgtgcaccgtacacacaaccgtctggccattattggtttgcgggtacatgtacactcacactgcaagccttgaccctatgactataaaaatcatattatcccctcatcaggcgcctctcactgtccgatcaaacctggttctcgcagatgctcgttcactagggccaaagtcatgataatgcgatgctagcggtatcgttggcctttccagagtgagggctttcgtcctacctagttgaatcgcttgtccgaccaaattcagaaatctgctgaattggccatgtcgccatggtcaaggcccctccccaaggtgaatgggtcgattcggctactcgcatggtcaagatcgccaatcggtgtataaactgcctcacgccactctctacactctgaaacctcgatgcgaatgcagattgaagatcattctccaacattcacattaggcaagtcgccgtctgaagttggggtcagctgacgctagattgctatcaatgagagtgctggagagtactcgagggctctcgatggatacgtggttccctgggtggcaacgacaggcactcaatgcggtcagcccgactcgatggcgcgtcgcacggtgtttctgcagcgttttatctcagtgtcacagcgcaaaaaccttaaactaataagtccagagtgccagcgcccatatatcttcgatcagggctggttcttgcaaatggtcgttgccggtgcaaaaacaatgataattcgatgctgcaggtaccgttggcttctcccgagcgagcgcttagtcccatgcgcttaatatacacattgtaaaagtttccgcgaatttggtccttttcgcaattgctcatcgtctttctgtctttgatcagcgctggttcttgcaaatggtcgttgccggtgcaaaaacaacgataattcgatgctgctggtaccgttggctcctcccgagcgagcgttttctcccacaggcttaatatacacgttgtaaaagttcccgtgaatttggtcattttcgcacccgttcatcatctttctgcctttgaagagcagttcgattccgcaactcagatggtcacgatcagcaatcgctgaaaacagtgccgcacgatgttcagcacactctcagaggtcgggaaacgtgtttagaatgatcagggccaaaaatcacattagcccaccctcgtcgaaatctgcgcacaggtgtatcaaagacagtgaacgtgtgcgaaaaagaccaaactcgcgaaaactatcataatacgaataataagtgcgtgggagaaagcgctcgctcgggagaagccaacggtaccagcagcatcgaaatataatcgtttttgtattgtggacgaccatgtgcaagaaatacccctgatcaaacatatatgggcgccggtaccctggatactacccgcttcaggttctctcttataaattcattatagtgtatattaagctgctaggagaaacccctcgccttcgagaagccaacgatgccgttagcatcgaaatataatcatttttgcactgtcgacaaccatttgaaagagccggccctgataaatggtatataggcgctggtaccctggacactacttggtttaaggtttttgcgctgtgccaccgaaataaaacgccgcagaaacaccgtgcagcgcgccaaagagtcctcgcgggtcgcattgagtgcctggcgttgccgggcgtagctacctagggcagcaggtagccatcgtgagccctagagtactctagcactcactctgatagcaaactaccgtcacctgaccccaacttcagacggccaccttgctaatgatgttggagaatgatcgggatgtcttcattccgtcgaggtttcagagcgtgaagagtggcatgaggcagtcttttcagcgtttggcgatcttgacgacgtgagtagcggaatcgaccgattcgtcaagatgagggacctttggaatgatggcgaatctaggctgatttatgaattgggtcggacaagcgatttaagcggctcgggcgtaagcgcacgctctggagaggccaaccgtaccagcagcatcgcaatagaacgccttttgcactgtcaatggccatttgcaagaatcggtcccctatcggccaatgagaggcgccggatggggtatatgtatgctgcatatgcgcttatgaaggtgtcagggctcctagtaaagtcctagtagaaaagtgcttgtgcctgaattctatttttttaggtttacgcgctctgcccatgcaacaattcgctgcaaaaccactgtgcagccagtatgccacgccaaggagtcatcgtggaccgctggcgcggctgtccagggcgccaggcatttaccgggagccacggagtcctggcaccctctgtcatagagtgacattggtgggcagcttttataggcgattccgctgattaaaggttgtcggacgatggctcttcctctgaggtggctatctataccggcggcattgcagtatgccatcatccccgttgtggtgttaattgacaagcttacaaaatgaggtgccagaggagggttgatgtgggtgatatgaaaatgccagagccattgtagaaaattgctctgagatggaacaggctcgttttcaccctaacagtaatgggtcatgctttcaagtgctgcttttcactgtacttttattgcagcttcagcctagagctgccatctcagatgaaccactatgaagcaaatggatgcttggactgcgccctcaggcgggaacactgatagattcttagtaaagaaacacttaggtttctcccactcagtgcccgtgtcgtcaaagtctcttgtattcaaattatgaccaggtaggaccgaacgctcatctcatacccgcacaccgtgcacttttagtcggagcctccgagtggcggaggttttctcccttgaatcgcttggtgctgttatttgcgcattgtccattttatggggagggacatcgtgaacggtgagttgaggcatggcctgtctcgtctcttttttctcgatccagagttcaaggaacgcagtcacttgcgccccgcccgcgcgttcttgactgacgtccatgtctttctccctctcacactcacaatcctgccctttctctacagtagcttcttaattcacgacagaatgggcatcgaagcaaactccccgaccgcgcttatgcaggcgacggtccaatcggactggaccgatgttgttgctgaagtgctgcgacttaacagcactggcacattttgggtgtcatgctacaagcgaggtaaagaaggctcacgatcgagtactgcacgatactgccatcgtaggtttgcacattgcctgcatgttctctgattctgttttcttgctccgattaggatcgccttcggtgcatggtgctgccaaggtgtctgttgcgggagaacggaagatacagtttactggacatgatggaattgttctcgaggctataacgaacgtaagatgcagtggttgtatctgtaccaacaactcgggcgacagtgggatgcatggaaacttacctcggacagcttgaacgtatttagtactcgttcaaagtcaaggtcccggagtatggaaatgctgaagtagaagtctacggcactggcaagagagttagcatgccaaaagtaagcaagaacttgtaattaacggtgcgagttcaggggcgcagggtgctagcgggcaagaatgtcaaaagtcatgttttaaccatctggcgctgtcagctctcctgtctagacatctcaccggagggagcgttctttgtcacagggtctgaggatggttcgctcaaaattggtcaaacagagtctggtcgtattttcgtaagatagagaacagacggttttacaggtctcacagtgaatgcgtctttatcttcgctaaaaacattcttgccgaactttgcgtgtagcacgatctgaagggccatctgcagtatgtcacttcatgccgattctttccctccggccaaggtatcgctatagtgcaccttgttcatggctttgcttgaaaaagtttgtgaactgatcaggggtttccattctcaatttctgtcaatagtcgttttaagcggcggcggcgatttcttgctgaaaatctggtccgcgatggatggacgctgtgcagtcacaatgacgggacacactaaacgtaggagccttctcgtggccacacttacgatttgactgaatcattctcgtgtactgacaacatgtctaccataatcccccttccccctgtaatagcgatttcggatactgccatcatcgatcgaggacgcaatgtgctgtgtaagatccgttttctgacaacatgtatacgttggatgccatgtcaaacgacgaaacggacttttaacgaggatttttgaatgctgtcatgtgtgtaaatgcatagcatcgtcgaacgatggctctgtaagactttgggaagtgggtgagtggcatatcatactagtacccgcttgtttgaatgcaagcacgtgcgatttattgatctttatcgaacactcctagcctctggaagtaccatcaggatacttgctcagctcgatggcaaagtaaacgctattgcgcttgacacatggacaacgcctttggaggcaaagaccccagcatgtaagaagtccagacgcacaacgcatatcctgaaggcaacaggatggcaaagagctgttagaataacccttctaatttcctcgccagcctcaatggaaataggaacggagggaaaggtggtcatcgcggtttcggagaatggcactctgcatgggctggatgttagggcttcagaggaggtaaatcgccatatttgccgcatgccttgcgtattggaactgagctttccaggtattaacggtgattttggctttacccttaggcttttcaacgcaaatcatttcaatcgactccacttcgcgcttgcgcatactcggctaagcactctatcgtagcgtcaggaacgtccgatggtgtagtcgaaatttttgacattcgcaagactgagtaagtctcaagaggaaagactcgcagcaccatctcgctataaaaacgcacgctcacacatatcgctcgctttttccatttcttatttcagtggtgttcttaataggttccagcgaggcacagcgggtatatccagtctatcgttcacagaagaagccaatggtaacgatcctcagttggtcgtcggttgtggtaagccatctcttgcttgtgctcttgccttcagtcaccgttcatccctcaaagcatcacacctaaagttgaaaacttcccacatgttctccccgtctctttggtgctgaagatgacagcggcctctatgagacaaaatctctgtgggaggaaacgattcaagttaaacgggagtatgtaggttttgacctggatggaccttgtcatgcgcgtcctatcggagcaggacggggtttggtggcgatctcaaaggaaggaggcatgctatgctattctgggaagcttggatcgcgttcaagttgagacactacatcggacacggaatcgaaaaggggcgaaggagggggacacacagacgggccgacactgtaaaaaaagaaaaaaaaattgaccgttgatgcatctttttgcctcgtttttggccctactgctttctgacggttgttctgatgggagtgtgcgtcacacctgttgtgagtccaaagacccttgttttgtatttcccgatggcggtgcatgtgcagagcatgagccatgccttccagtctcaggtcgtggatgacgttcttttgagagctttttttgtcgggtcaggggctcaggctcagctggacatcatggtcggggtacaaagtcttcagtaccatccatccggccagactaatatgtacagcttactgaacaagtcaaaagtgtgcgaggcgatgagggagaaaagattccttctttttgggcagatatgtggatcgtcggatgggccttatcccagttcatgccagggttgaaaagttactgttcagccctcttcagcgtcgttctgtgaggaagcaattgatcgaaccatgagggcacgcggaaaggaaaatgccctcaggagaggaagagggactgtgttgactttttgtacaacaacattgtcatggcccttcgctacagcaaacaaacaatgggaaaaaaaaaatagttgctagcgtggccgcaaactggaggcaggtgagaagggagcgcctaatcccgcactgaaaaaaagatatctgtgaacgagtcgtcggcctgtttttagcgatggggggccaccgtctgtggcggtgaggatggcggggaggcaagggcgcgattcatctttggcaagaggcatatggaagctgacccacatgggtatggctgtcgcaaaaaaaaaaaaaaaaataacaatgtgtggttgtccaacccccccccagtggattttttttatcagccctgttcctgagcatgggtctgttgtctctctctctctttctctctctgtctcttccgctttcctcgtcttgagactctcgcgctctcgctttccctttcgaatcgcttttgttcccattcctccgatcctcattgcttatacccatccgaccttagcctggtgatcccgccaccctcctgtaagttcaagagcaccacccacaacacctcaccgtagtgtgcagtctagatacagctctacggtacatgtacagcatacaccatgcactcgtatcagcgcagagctctctcgccttggcctgctgctcacaccctacccagtcctttgctgccccaccgcaaaccaccaccacccgcctgcacttgctctttcgtccgcggatattacatttcattcatctccttgtttccactccaaccctgtctggggctctctcccttgtcagtctagcctgttcgctgccagtctccatcactccttttttccgtctcgctcgcctgctccacgttttcaaccttctaaaatagctctttatcttttccttctcgcactctcctgcctttggggccttgtctgccttccgtctcctgggtgccatcttagccagtaatccataatccatacccctcgccctcgcaccataccgcaggtccacattttcgctacctttactcgtttaaaggctacagcacggcctcgacagtgcaaccaacgacagagagcaaggaagaaaaaaaagtacataagtagcaatggccatcggtgcccctccgaatccagtcatcgatacgcgtccgtttcctctggctgggcagaatagtcaaggcctcactctggacgacaagagcgtgcaccgcctgggcagaactaatagcacatcgtctgtcatccccgcacactcgtcccttccttctccactctctcctcccctttcggtctcgccaccgtctatcgggtccacaatggcggaactcgtcgcctcccatccctctccaaacgccttcgcgaatgcctctctacctcccctgcctccctcttccgctgaacacagtatcacccacagtagtagcagtaagactagcagtatacacaaccaacactcgacacgaggcgggctaggtgctaccggtgcctatgttcagacctcgccggaggaatggcttgcccatgcggcacagcagcgtcgccatctctctacaggatccctctcttcgacttcatctgtctcttccacaacacgactttctcccgaccgctctctgacgcactcgccctcccgcctcgagtttggcgagagtgaacgagttctcagcgaggatgggacggagcaggacaatgaccgagagccagaaatcaatgtgaacatgcgaccttcggagctcagggcatcgttgatggcgagggccaagcggagctcagccaagatgcagcagcagcaacaacagcagcggcgctcagagtctctgcctttggagaagggctcgcgactctccgcacaatcatgtcaaaggtaaagtcaatgaaatttatcttcacaccatccgtctctccacccgtctacgcacccagctctccacccatcttctcttcatccaactctccacacatctctccaccgaccccgggcactctcaccttttctctctcagtaatgtgcgacacggattcctacctttgattcgacctacatggctgtgcgctctcttgcgacctgacccctatggtggacttgagagggggtaaaaaacttgacactatgaagtccaaaaaggacaccagatgcgccagaaagtgccctgctttcgctatcctgcgtgtcttttgcgtgtcctcgcccttgacagcctcgcccttcattccctacacaagtctatcgtggccagccgtaacaatggcatccacggagtgcacgcaccaacacacaaagacgcatccacaaacacacacaaacagacacacgccagaaaaaaaaaagatctgaccctttttccgcgctgctgcatggctgtcgaaacgcattctcatatgtcaaagcggtcaagggggtgcagaacgaggaaacaaggtgtcgcagtgggcgggaagttgcacaaggggaggagacgccttactgtggctctacgaggggccgctgctgatatctcaaaaccgttccgtagacaggcgcgtgcttagacctgcatcaaaatcacccactaaccctttttcttgcactttgcctccccccgaccttgccacactcctcccattcgtccattctctactcacaacccatatacatcgcacacggcctcaacaactcgatcgacatggaacacagtcttagtagcgcgttcgagtcgcgcctgtcagttcagtcgtcaacgtcgtcctcgcttagcggatgggcccctcgcgcacgttctgcctcagtcagctcccaaagtagtaacgattcggtgaacttagacgcgctcattgcggagggttccgacatcaatgaagaatgtcctctggagcttgaagaagccgacgacgttgaatggagcagagttcagcaacagctgcagctgcagctgcaacagcaggcgttgcctcaagtatgaggtccagtcatttttacaccaaggttgcgtttatagcgattgcatagcatactaaccaatcggatgtctttggattggactgatagcctgtaaggagcaggagtactacagttggctctgaggcaaacatgctgcagtatgacgaccatgacgtggatcaatactgggagggatctgatgtacgtacttgacagcgatgagacgcagttttacctttatgccgaatcgcacctcatctgacttttgccttttgtgatctttgatagatgatcgcaactgaggaggatgaagagtttgacgaagccttgagagagttctcccagttggcggtaaaatcctcatcaaccgaggtgcgcggcttgacagtacagagacaaacggcagctggatcaacacgattcgcagatggcaggaaccatttcgacctcgatggtgattacatggataggccgtcgggattgcgtccagtgagcaatcgcaccagtacccacagcaattacagcagcacgagtagcaagagtaccggcagtaagctttcggcgccaagcgcatcccgcgctcaggcatccaccgcagcatccggactcagggcacaagcgagcaaacttgcgcaacctaaatctacgcttgctcagcccaaaaccgcaacatcgttaaccgccgctccaaggacagggatcgcccgaccgagtggagtgcaaccacccagaactagctcgcaagcacccaagagcgggctgcaggcgccaagagcaacctcagcgctgggcagagcatcgtcgctcgccaaaccaacaacgactggcctcgcccgcgctggcgttgtgtctaacgcagctaaatctaccacagtactgggcagccgtgtttcctctaagcccacgcaaggtcttgcgcgaccaagtgcatcaagggtgcaagtggctactcctggcgccgtcaaacgatcacccgcaaccccctcttcaacctccaaccggaattcacttttgcctgcaccgtcctcggtgtcatcatccaagactggaatcacatccagcagtggacgcacaactccaaacaaccgcactatgaccagccccaagcgcagtctgacgcaacccagtttgctcaccagtcccatgcggctaccttctactcgtcaggccagctcctcacacttggtttctcccacatcttcacagtcctctacatcctctctgccatcattggcgcatggacccaacaactcagcagcgccgctctcacgacgactctcgaacgctacaggtacaacgcgtcagaggacggcagcctcagcaggacggagcatttccatgtacggagccagctccttgcttcagcatcaagacgactatgagtactctgtgctgactccaccacagtcaccatcctccaagatcgggtcaaggacgccaagtggccttccacggtcgggcttacagaccccgtcgtcctcgtcaagactgatttcgcctacagtgtccacctcaaggatcggacgcccctcttcgcccccctcccataccttttcctctagaccccataccccgacatcctctctcccagtgtcgaggtattccagtggccttatcagccctcgcgctggacgcaattaggaccccatttgtataaaaagtgcaccacgtgacttctctctgcgggcgattgttgaaagtcactttttttttcctttggcgagtaaaaacagctttcttcactctccatcaaattgcactgtcttgtactctccagcaggcggcatcaaagcaacactacttctgtctatccttttcacagcagcagccattccagtaatcagcatggacgagggcaagggtcttgaccccattgtcgattccgactctaaagcgaacgtgcccgttgtggacgagcagaggcaagcccagacccagaagattcggacagagaatcgtgagcgcaagaagagatggcgcgaggccaatgaagatcgaagtaagtttgcaacgcggatggtgaagagttttgggagggaggtgcaggctctgacctcgtccaggcgcaaaagctgatcgttaacaatgggcagtcaaggtgggactgccaaccatgccgttgtattcgtgactctcgaaaagagagggcacgacggcgttcgcaaaaccgcgaagggtggaaggggagagtgagcctcgctgacgaatatcctcctgttgcgggaacgcgagtgtccttgcctcttgttgtcgtggagcctattgttttccaaccatgaacctgaaggcgggtgcttctatcctcgtctcttctctctctgcgtattttttttttcgttcggttttttgctccagaccacgtacatgtacgggttcagtcgacccagagagttgtccaagtcaaactatgccagcagcatcagagctcctgccctctttgatatccatgttcaagaaggcagccctttcatgcctcttacctctccttgcccatttcacctttctctcccatccgcataaatggccgccgtcccctaaaaatctgcgtgcacttgtcaggcttactaatcacatctgttccgccttggactgaaatagacaaggataacgacctgcgatgccgagtcaacaagcgggccagcaagctcttcggaaaggcagaaagcgatcacaaaacccgttggatcgaggaggagtttaaaaagcgtcagacaaagcgccgggagaaggaactcaagaagaatcccaatgcaacattcaaagaccctcagcccgccatagtctccaagccctcggtcgcgctaggcgaccaacagtccagtcatattgcgtctgtcaagccgattgaggcccacttccaattactccaggccacagcttcagcgctcaacccaaacatgcctcagttcgatgcgacgactgtcaagaccgcactagcgcttaatgatctcgtcaagaagaacggcaaccatctggatttggcccagttgaccggcgtcctgactgaccccaacctggcgcgtcagttgatggagctggaagcaagtagcacggcaacagcagcgcaaacggctgcaagtctgatggttttggacacgccgccgcagttggcaccagagcctcagcaagagacgaacaagggcaaccactccctggacccagactaccccatggatgcggtccttacacttatgcagttgaacggtagctggaaagcataggagcgtgtcaatcagcaatatcgaattctacacgctctcctcttttttttttttttttgttcccatctttcgactccactgcagcactgcatacataccaggacagagtgcgctcttcgtctaccgccactctcagttcagtaaaaaaaaacatgagcatacatctgccaccaaggatcattttagtgaaattcttttctttcatgtattctttgctacataacaactctccgaccattttccatcgccctggagcatgaacccctttgaagaccatccaccgcctacgctgctaaaaaaaaagcagccatcctgcctgcctgatagtccacagggaccgagtaactcctcacttgtaagatgccaaattgaatgcctgcctgaccacaatgactgactaacagacggactgattgactgactgactgaatagactgaccacctccagggaccaaactctccaagacgcatccaatttcctacaccggaacccttcatcacgaagaggtgacaaaaagacaatagaggaaaaaagggcgcgaaaagagagaaagaaaaccagtgttacacagccagatctggggacccgaaatttactgacccgaacacaataaccctctcatttttgtttttgtaggtggtcgggtgaactgagggggttggctaggttcactcaccctcttgcgctcgctgtgatctgcttctcccaaatggtcctttcgtcgcagtactcccgacctttctcttgcttgctgcccttgatcattcgcgacatatatatataaaaacaaaccagagctcttcatcccaacccacccggatattcgatgtatcccccttctccaatcctcggcctaaactgttcacacacacaccgatgtgcaccatcagccctcacgccatattagtagcgacccgagggaggcccgtactgctgtgttccgtaggatccatatccttgctggggctgaggctgagttccgtaggccggtccgccgtagctgccatacgccgggttcatgggcgaatatcccggggtgggaacgggcgcaggctgctgaggaggtggtgcatggtgctgcgttccatagtagctcatgttgcctcctgctcctcctccgagtccgccgccggcgctaggtccgcctggagccgagggtgcgctagtgttgcaacgggcacacgtcgttctttttgcaaagttgtggtatccgcactgagcattggggcaaatccagtcgccgggcttcacaggcgcaccgcccatgggctggggtgaggtgtagttgggagctggggacgagtcgcgcgatggcttggccagaccacaccgcatgcactggaaacgtgatgcaaagttgtgagagttgcaggaggggcagctccaatcgccaggccggaaggatccaccgcctccgctaccacctccacctccggagtatgaagatcctccttggtttccatactgacttccgctgccgccaccaccgccgtaggaaccaccctgagagccatacgatccactctgagagccatatgaaccaccttgagagccatacgaaccgctctgcgacccaccgcctcggcctcctccgtaggagctgccatagccgcctccacctccaccgctgttgtcgctgtaaccaccgccaccatacgaactgttcgaactgccgcggtaacctcccgagccgccgccgccacctctagaactgccaccaccgccaccactctgaccggttagaggtgaactcgtcccacacttgaagcactcagaacgagaggcaaagttctggaaattgcacgatgggcagtaccaatcgccctggcggaaactgatggaatgaccaccgccactgccaccgccgccactactgcctccagaggcgtatggatgatggtggtgcgagtgatgagaatgatgatgtgaaccagccattggacccccgttgccatatccgtttccgctcccactgccactgccaccaccacttccagaagtacccggtctcactgtttggcagcggaagcactgtgagcgcgaggcgtagttgtggaatccgcactgggcgttggggcacatccaatctcccgaggtgaaattggagggcgtcaagggcacaacaccttcaggcgagggtgagttgcacttgaaacaggctcgtctggaggcaaagttgacaaactggcacatgttgcaggtccaatctccaggtctcggcgtcggctcggatttggaactctaatgaagcgaaaaggtaaagaaaccactgttagaaatctcgattgaactcttctctgagtggagtgcacacgtcataactatgttcgtctactctttgtctcttacctggaaggaggagagcttgcccttttgcgtatccatactggccttgctcgaggggttgacctcaatggtgcgtgaacccaggatttggccgttcagctcaagggccgcgagcgcgtcggaatgcttctcgaaaacaacgaatcctccgccgcttggcctgttgctctgagttgagagcatgaccagctccttgggcttcagctgcttggatacgaaaaacgcctccagctcggcctgcgtgatgtcataggacaaggacgagatgcgcacaatcttggactcttccgtcttgaacattctcagcatctgagcggggtcaatggcctgggtgaaaacgtctgggtgggcaaaggccacgaggtatttcatgatggcgacaatcgtcttggaatcgtcaaggcccgagtgcaatgatccgaccagtgaaacggcgaaggcttcgcacatcttttccagcgaaaaggacttgaggacgacttccgaatggtgagcgatccatttggtggcttcttccttgagatcaaagagaatgggctcccgaaggtaagggggcagggtgatgttcttctctttggcctcccttggcagctgcacgcgcaagtcccaagcgccgtgtgtgacaaagcagaaggatttgcccttgtccaaaatctcggtagtgatgtatgcgtcgagggactcgatggcctcagcgagggtgcctgcgttgtcgagtgtctcttgagtgattttggtcaaggcctggcagaagggtgtcagtggagtcgagacgggcttgacatatctctgctcctcgtgctggatgaccaggctgttctttgtcacgcagagccatgcaaactcgatgatctcctgggtggcctattttcaggtgatgacaacaaatgacaaggggcgtgtcagtaaaacaatccaaacgagatctgcgcatggctttcgagcagcagcaaaagcaacagcttcaaggtttgttacataccccagtgacgagaagttccgaggcaggtttgttgtcatcgcaggtcgcttcaaagtcgaggacgatgtaaaagtcgtattcgctagtggggactcttggtgccttggagactacggctggcttggcaggaagggatgaggggatcgttggcgccgtggcagttgctgctactgcgtttgaggaaggcgaacccacactggaagcgtccatcacagcaggttgctcttgagtgtcggacatctagatggtttgtggtaaggtgatgatgttgaggtgtgaagatgaagagccgctcttactgagcgacacaaaagtcgtcgtggtagcccgctcagtgcctcttcttcgtttcctatcgctcgggtcatatatcacgtgctacacatgagctggaaaccctcgtgacctttcccactcttcattgaacgtgccacttcgttggaccagcgtttctcccttatgaccgatacgatataacaacacctagcttgcttcagtatgtttacgaagaaggcaacctcaagtatgccacctccaccgcttcacgttatgcgagagcttctcggtgaattgcgacctttaaatcttttttttttcttgaagtgccaatcccttataccggtgagtgaatgttactgttgctatgccatcaagactaactcctcgcagcgcacgacgtcgcaaagactcttgatctgcaagtcgcccttcagcaggttacacggtgcctcgccgctgccataaaacaccatcggctttgcatgagaaggaaccagccaaatcgcgttatcttgaaaatggcccgcgatatcatctcttgcccattccagccagaccagccccgcaagagcagaagtatttagctggaagtgaatttcaaacgatgtcgtagaggtgccttcgttctgcctcaattccaaacgagatacacggatttcgggatcatcagggtgtagaccagtggctaacggaaaagcagatcgacagggaaatatctggggtatcatcgcaatcgtctccttagtgcaagtgttgtcagtaagtcgaagaagtgtcgcttgggcggtgagcaagtgtggactactttcgtcctcacccaagaggttctgattctcgacagtcgtaatcttcttgcttgagaatggctcgatgtgaaatgaaagtgtgaactctgccttaagacagctcgatgcagtgtcccaggactgcaccttcaggttgcctaggccgaccacgcaacatttgagtattttaggtgagaggggctatgcactcggccatgtggaaatgtcctacgagaactcacccttgactgggaccgatctgtcgttgcagatgtagatttcaaaggagcgaccttcaggcggctgaaagccagagatcaggacctcagcaaacgcatttttgataaagtaatggagcggcttccactgccctgtacttgaggaaagagcgttgcattagaaggctctacaatggcatgcgtacgttaatgggcatgaatgaatgttacctccatgttcaatgcttgaccctatcaaaacgaagtgtttgatttggtttagtgaaggtgaatagctcctgcgcacgactgtgaagtttggcatcgattcgctcacatacatgtcggagctggccagatgtcgtttagctgccagtacagtgcgcccatggttcgactctcagcactgcgatttcgtatatagtgttctgtctggccaataatggagcgcgcctgtacacactgcgtcatgtagcagaatacatcaaagagtttttcacgcgtccagacatggactgatgacatgtcctcaggatctgagtgataatactttgaaacagcttgtgggagttggaactgaagctatggcatgcaaaagtatgagatcgtcaggcacactgacaactctgtttggaccctcacttgatcatttttggagctggtactcgctggttacctcgatttgctggagcatctcctgctgcccattgccatggtggttgcgatgcacagaaagctttgacatagggtgccaatcgtcgctcgaagatacctttttccagtttctaaaacaaggcatggactgtgctccgtattctgcacgattcgttaaaaaaaaacaagtgaaggtgtgctttggacgaggtaacaagaacaacacagtaatatttaccagaaacaaatcgagccttagggtagttctcgacgtgtaggccattgttcatgtagtcataaaagtggacgtcgccatagagtcctctttcagaatcctggagtacatatcgttctgtgtagggggacttggagaccaaacccgcagaaggagagctagcgttcgaaagttgaggtatatagcgggttaaatgcaagaggagatacgctgtcatgtctttttttaaaagcaacatgcacacttgggtgttacgttgaaatgaatgatcttgatctgtcgatcccctgcactgtcgtcatgatggtctcgatatacagcttatagtagtccacctagaagacaagaacacctgtgagcaactgcagcagtacatcacagcatgcctcagttgctaaatcgccttaccgtgaagagataagggttgaaagcggttgccttatcccagctaagagaacaaaaaggacaaactgacctgcatgagtgtcgtcagatgcgtccatgggtgtctgccacacatctagtacatacttcttcaccatgaactcctggttctcgttgttgccagaccagagaactatgcaaggatggaccataagcctagaaacctgataggagacctcttgcttgacattcttaagaaacgcatcatcagtgggatagagggcacatgcaaacctaggaacagcaacgcgccttagcatttggaagaagggcaagagttggctgcgaagagtagaacaacatacatgaactcttgccaaaccatgatcccgagctcgctgcacagctggtagaattctaaaaatgatagtcatcatcagctcgaataggcctgatcgccttgccgacagtcgcgtgcttggtgcctaccatctgtctcatatcgcccgccaccccagatgcgtatcatattcatgtttgcggcaacacagcttgacagtagttgtctaacagggtcaccaagtgatgcacaagtcaggggaggcgcagaccattgtcttagaaccgcggtgtgagaagttcacaccacacacctctttttgtccatggtcatcaggctgtcaaagacatggcccgggatccagtttgcgccctttgcgaagatttcaaggccattcactcgaaagcagaatccatcgcccggtcgttcgatcgttagcggatcctgcgccagttcacatgtcttgaaaccacaacgaaatgactgtgaggcaacggtgattgatttctcgttcacaagtgtcaaatccaaggtatacagtgtctgctctccatatcccctcggccaccatcgtttgacggacgcttcatccagaatgaacgatagctgcgccttgttatcaccactgtgcacagccactttgtgcttgaatgacgggagctcgtctctgaaaagggcatgtaaagtgagcagttggtctcggtcgctaaagatatccatgcaaacctagcaaagatgatcgtcagatcccaaacacgttttatccatcgcttcgccaaacttttgaagagtaccttgacttcccaacaacttttgcctgtgtcgagtgacgtgaggagactccagtctttcacaagtatcccttgttcatccaatttgagcgagataggtcgccagatacctatcaattacaacgcccatcagctacatcaatgcagtctttcatctgaacaatcgtacggttgcaatcttaccgcagggagcaaaagcaggcccccagtcccaagagaacgagcactgcgaacgttatacagcatctaggtcagtaaaagtcgcactgaatccatgcggcgtgcgcgagcaatgatgggctgataatacctgctccttgcgaataaagttgcggcgtggaaacccatgctgagcggcgctcatgttgaacatgtccggcacctaaatataaagtgcatgtacctaaacatgtcaaaatacgaactgctcaagcgcacgcctgtcggcattgcaggattctcgaccacgtacatagtagggatatgcgccagccctttccttcgcatagtggacagcatcatcgaactgaatttgaagagtgttctgtcccgcctgcaatgcattcgtggcatcaaaaagatggcgtaggaactgattctcagtcttcccgatttcaaagccatttaatgtgacggaggcgaccgtatcgagcccctcacagtcgagaaaggcggcggtaaaggaagcatcatctccgatgacaaagtcttttgtgagcacccaggtcgtggcaatgacctttcgcatagactcactatcaaaaaaaggacgtgcctgtaaggttcaagtggcgatcagttgtgtgcaattgaagactgggtgtgaaaaccttacttgacatagttggtgccgtagtaagggtcctcttctaggtgcctagagcgaatcaggtcctgatgaacttggcctaggcgtccagcgcagcaatgagagagttcatgagcaccagactattcctcctcctcaaaaaagaatcgctttccgaacttgctcatgcacacctggaacaatggacgtggcctgaatcgaattgtccaagctgttcaaatgccattcgccattgaggtcgacagtcgttgatcccttctcacggtgcttcagcatttcgaacaggcagaaatatgacgagtgaggtagcggataaagttgtcaaccgtgtgaaaaacgacaaccactcggctatgggaagctccaacgccacttccgccctgattctcacgcacagtctgcaagaataattatttctcgagttttgtgaccgagcgagagagccgcttgtctcctctcgcacagtgagtgcatggtgttgctttcgccctcgatgccatacaaacccctttcatttttaatcaacggacgcgtgcttttcgcgcgttccatatggctctgatattcagaatggttcgcgcgattctagattctcacccccccttccagctccatatccactggcgtggatcacggccattgtgtaaggcgctccacaacactatcgcacgttgaccaagctccaaaggtcacgttgtaaagggcgttctgataaagcatagtggattaaagaccaagctggtgtgcagccatcctgatgcccacttttctctctgaccaacacactttcaggcatgagaccacgcaccatcactctcgttctctcgctgtctatagctgtagtcacaacagctcccctcaacgccatctctgacaatagcgaaccctttgagtccctcctgaccccttcattcgatgctgtatctaaaaaggcggatcttgcctttgaagcctttaccgccatcagttcacagccgagctttctgatcgagtttgacctcacgccagcaggactgaaccgacatgaaagacttcgcatggaacgcaatggcgagttcaaagcgtttgcagacacacgccatggagttgtatccgctcagcatcaaagattccagtccttcttgaacgacaacatgaacgtggactacgccgtgcgacatgaattttttgatcttataaacgggctgagtatcgagtttcagggcgtgtcacagaatgagatccaacagctcctggagcaaatccgggccatccctggagtggtcaaagtctcgccgcttgtaggtgtcaagctgatctttcaggaacatgaactacgagaatcaagcgctgacatctaggacgtttggccgatgttcttgttagatctcagtcagccagcccaagaccattgtacatgagacagggttcgacattcttgccgctacaccccagctaagcacagcacatgaacagacgggcgttctgaaggccagggaggagatgaatcttacaggcaaggatatcaagattggaatcataggtaggcctgacatcttgaccgcagcaaagcaaactggtcgaaacgcttgagtggcggacaagcatatgctggatcgtaataactcgtcttcttatcagacacgggagtagactacacgcatgaagcgttagggtcctgttatggttagtcttgcttacatatattcactggaatgccactatggaaaagatcatcactagctaatgatggtgtatatgaatatgcacaggacccggctgtaaagtccagtacggctatgactttgtagagccatctaatgcagaagaagcaggaggatatgattgtgtgggggttagtacgaaacaagcacgtccgttctctcttgtttgtcagcgcttttgatccttcagcgctcgcgcaggcgacgtgctaatgctttgtcttccgcgcatatcatggtagcacggaactcacgtagcggggatcatcgctggcagcagcaccaagtccaacttctttggcgtggcgcctgaaggtattttgagtggacttttcttcgcacgttgaacgaatgccagaaaatgctgccacttagcccaattttcctctccgtattcaattagcgattctgggaacatatagagtgtttccttgcagtggaaccgctaaggacgatgtgatcattgcagctttggagcgcgcctatagagacggcatggagatcgtcaatctctcactcggcggcggctcctcgtgggccaatacccctctgtcgaaggccgcagggtatctatcccaccttggcgtggtagttgttgcagcgattggaaacgacggtgacctaggaatcgaagaggtctctagcccctccatcaacgagaatgtcatctctgtcgccagctatgaaggctctggcttcctggcttactatttcgaggttgaaggtgcacctgatgtgcgcatcggtaagtgaactgagaggattatatactatgatagtgatagatatctccacgtttctgacagaacaatgcatgttcattcgtttttgtaaagactacatggatgtcccgccaacgggtcaaaccggcatacctctggtattgatggtgcctgagcacgatccgacgggatgtctgccctacccaggctctcaagactcctcgaaccccatcgcaggcaaagtcgcgctgctgaagcgaggaggctgtccgttcacttccaaggtgaatatctgaacgaacacttcgcatccaatcgcttaggtgaaactgttttaatgacgcttgaatgcaattgccacacttatgaatagatcgcgctcgcccaaatggcaggcgccgtaggatgcattttttacaacaatgtcgaaggagcgctacgaccaaaagctacaggatcgggcattaacatctttggccatgggatctcactaaagcaaggcgagacccttctggaccagcttgaggctgcctctgataaatcgatcaatatcgtttacagtgacaaaaagggtgtgtttgcgaacgagttggcgaatcaaatttcgaccttttctagctggggtttaggaccagaactcgagctgaagcccgatattgctggtccaggtggatacatctacagcactgttccggtagcgttgctgagcagaatgtatcatgataacgcctcccactcttgccattgtgactctactaacatgaccgctatttcgagaaaatttaggtcagcaaaggctcgttttcgaccatgtctggaacgtccatggcaacaccatatattgtcggctgcgcagcgctgatgctccaagccgattcgtccatcagcccagctaccgtcctgcagcgcatgcagctgtactccaagccaaggccttacaaggacacgtcagctcccgattccactgctcgccagggcgccggcatggtccatgtttatgatgccattcagggcggtgctgcagccatgccagctcacctcgcgctcaatgacactgatcacaccctcgccagctacaccctcacgcttacaaatctctatccaagcgctgaggtctttagaatctcacatgttcctgccatatcagttctaggctacacaccccttgggcaacccgcagacgcgatcgtctacagcaattccactgcagaattggtgctggatccatcaaattcaactgtgcggctggaggccggggagtctcggccagttaccttcaggttcacgcagccaaaggaccttgacttggagagccactggatttacagcggatacgttaaaatggagcccacgcttgatactgcccggccagcaatgcacgtcccctatgcaggcatgctcgggtcatacggcaccgtagatatcatggaccttcaggagggctttcccatcttactgagttcaacgcctgacgggaagctgatgccgattttagacaacagcagtcctgaacctccaaccttcacgatggccggcaccgacattgtatctatacttttcaagatctgcaatcctgcccgagagctccatatctttgtgctggacgaccgcacgcaaaaggtggttggtattgtcccggtggacgcagagtatattggacggacggatgctgtcaagacaaagttttttagcgttcaatggaacgggaagatttccaggccccagacagagaccatcgagaccgttccagatggcgattactccattgtggtgctcgctcctaaacccttctcgaggggcattgggatcagaggagagacacatgagagctggatgtctccgaccattaggatcaagaggagcgcaaccccgggtggcgagatgaagtagaaccttgtgcgtcctacttacctctatgacactcaaaatacagttgaatcaacgttgctcaagtgcgatgagcggatgcaattcgagaatgtgaggacgatgagttgcgtcaatggcaagtgtgcatccggctgctgtgcctgaaatttaaggttgtccaagaagacataaaatagacaagggtgttcagggggatgcggccggaagcgagagggtcagttatagcgatgatagagcttgtgattgtcggcgacggccatagttgtgctctcacagctctccaagttctttggcatgctgcgactcgcatgactacggacggggctgaggttcacatcataaggtgcgcctttacttagccgttggtataacagtggtccattgttacaccgatcgccaatgcatgcaagagggggctgaggatctgtaacaagcgctgtgctcaaagaccagagtctgtgcactaaacctgccttccgcgcacggacacagttgccatgtagacgaaacaccatcgctgaaacagaccacaagacacatggaatcggcagaggattatggtggcatctaaggttgcctaatttttattgtaagggcttgagatattggaaatttctaggtcgctcttgggaaccagccccaagagaactgctatatcattatgagaagatcgctgccggagggaaagtcgatggggagggtatcatgacaagaccaaggatccagttacgcggtgaacgtttagtaagccttgtcgcagatgttgatagcctcctgggcacgggtggcatatcgggtggggtaggcagagcgctgaaccttctgtgcagcagtgccgatgggcagggaagcccagccgctgacacccttgagggcctggtagaagagagcggcagacgaagcaggctccatgcactgtctggcggttccccacatgggagactgctgctggaagataccgacggagagatggtcggatccaacggcatcgtgagcaaggttgcacgatccagcgaccttcatgttgcagtagaccaagatgttggactcgaccaaagcggtggcaatggcaaccgcgcaaccgcgcgaaccaacaccggcggtgcgagcaccctgcgcaatgatgcgggcgtatccagactgcttggcgttcaagccgggcaagttgccgccaggtggggtggtgccaccgcaggcgggagcagcaggtccatcagtgccggtgtacacataggtgtcggtcacgtaaccgccgggaacgtggtcccagacgctggaggtgccgaacttgccagtgacagtggtgccggtagcagtgcagtcaatgtcgaccgaggcaccgttcttgatcgaaccaacaaccgcggaggaggtcgagggggcagagtggatgttgaggggatcaccagcggtgcggacggtaccagtggcagcctgggtggaggcgatggtggcgacaatggcggcgatagcaagagtgaacttcattgttggatgcttgtacttgtgattggagttgattggaagagtagtgcttgcttgactgttgcgctggaaggcttgtcttgctgatgaggttgttgaagaggatgaggattggatttggggtggagatcgcctctcttttataccctgaaaatcgcaagtagatccaaacatgccaccggtggatctaagagacgagagtatgtctccactctgagcagtagccggtgctaaacagccggcgtctgtacaaatgtttctggtgagtgggtctcagggtgtgtatctggcatgtaccacgcgctagcatgctcggtccaacaggtagcagtcctgagttgagaaaagacgccgcgcgcgcaatatacacagattgctttgcgaggtatgaatgacacttcatttcccagagtgttgcttttcgggcaattgtgttgacagttggtcctcattatgagtagactacatgtacatcactcatttcgtagaacttctctaaaatgcggaccggaactcaagagccctcgaaagcaccgccgactcgatagttcttattcagtccctgatcgagtctatgacaaagccgagcttagcggcgccatgctggatcataacaagatcggggttctggtggtgagaaattgcgagaatgtagactactctcagtgtttgcctgcaaaagaagcgtctgtcaactttgagagcattcatgcggggaggatagcataggaacacgcaagaagtggctatacgatcggcgattgggcataggataacagcgctttgaaaacgagatgtagaaaatgggtaactaatcttgatggcatacatgcagcaccggcactggtggagcaggtgaaaacacaagagcggttctggctggaaaaccaatggatatttacaccttgtgtagagcgcacagatgggtgtgcatcgcacagtgcagattccaatgccgtagcaaagcagcaaaaacaatgcgcaaacggacaatttgcatggatcattggcttgtagtcgcgatcaccagctaaaaaaaaaaaaaagcacttgcatggaaccttaaagctcgcgccgcgctttctgcgactaactggttgcactgcccaataaacccgagggctcactatttcattccctgcgaaaggataatttcgacgttgaacgacaaagaaaccttaatgatcaatatggcagtgcaaaaaaagtccagctctcattccagtgctgttttgggggtgagttcccaccaccgatttgagccgtgagggacatacacgccggccattcgctatgaagcgcgccgtcttcattttagcagttgagtgatggaaaacggccgctttcagacaatctcgagttctcacgattgcattacgttggatccggtagctttgccgctcagcagggtttccaagaatcagagagggagaagagaggagagaagagagggcatctgagttagggtacagatcattcgtacctagcgtgatccctttaactgacgctttattagattttgtattgacgccaaatactgggtgccgttgtgaagggcattgtctcggaggcagggtggtcgacaattcgttaaggaagacattctctgttgatgatagctgctcaaatcaagtcccatccttgcttaggctggatcaaataaatatgtgtgatggtagtctagagactaggcagttctctttcctcttcgttcgttgctgctgctcctgatgcactatacacgtcttcgggctcagacgcgactagacattccagtgtcgcactccatctcgttacgacacattgttctgcggcagcttggtgctgaggcggccatgcggcgcgccaagcataggcaggtttcacctgcgcgccggactgtgatgcgccgtatggggcaggcggccaaaaggctcaccttttacccctatgctggcccccgcgatcagtaggaactatggactgagctgaatcattgattgggcggtgcaaagtgcaaatggcgccgcgcttgcataacccaatttagtagtcaattaggttcgggccagtgcaaaagaggcaggtctgatcgcgtcaaggggtctcggaatccaatgacagcaggtggactcgccgttcacttctctcgctgcttcgaacatggtttgcttctattacttaacgagcgcaatcatgtgggagagctcttgttgttcttgtttgttagatctgtatggtaatgtagcaaacattaatgcgcacagatgggagtacaacacaacgattggcgtaatggtcgacgacaggtcctcccaccccagttatggttctcttcaggacggcggcatttttctctgcatgtcgggccctccatcgtgcatcttcacaacaggctagtctcttggtgtccgctcttagcgttcgatctgtttttagagtaccttttacaatgcgaaggtcgcgggtgctctcaacctctgtccttgtaagaactgtctccactgagtgcctcgctcgggaatatatttttcatggtacttttcacaagcgctctttatgaccctgtctacgtgatacactgcaatagtcaactgctttatagtactgtactctcgcaatcgagtcggcggtgttaaggctctgttcttggtcatctcaacgacttgcatcaggtggccgtagcgacttcacggctaaaagcactctgcactccgatgtaccagcagccggcatgtatcaaacgtatggatccaaaccttccgacaagtgttgaaactcgaagcgttatcgttgataatgagggaccgagggtccacgcgcggcgtgtccttgctctcgcatattctgttcacggactgaccatatacgtccaaaatgtgcttgtcgacgggtgcagggttgtcagtagagtacacaagtgattccagcgacgtctccgtccactagattcgccggtgcatgtttggatctacttgcgattttcagggtataaaagagaggcgatctccaccccaaatccaatcctcatcctcttcaacaacctcatcagcaagacaagccttccagcgcaacagtcaagcaagcactactcttccaatcaactccaatcacaagtacaagcatccaacaatgaagttcactcttgctatcgccgccattgtcgccaccatcgcctccacccaggctgccactggtaccgtccgcaccgctggtgatcccctcaacatccactctgccccctcgacctcctccgcggttgttggttcgatcaagaacggtgcctcggtcgacattgactgcactgctaccggcaccactgtcactggcaagttcggcacctccagcgtctgggaccacgttcccggcggttacgtgaccgacacctatgtgtacaccggcactgatggacctgctgctcccgcctgcggtggcaccaccccacctgcacccggcggttgccaggcacctggcatctcgaaccctcgcacctgcgccggtgccgtccagtgggccgtcaacaacctctcgaccgcacgcaaccccgagtacattggaatgtgtgacaagatcatggctcgcgcttacggccgtagttactctggtttcacctctgcctgggtccactggcagtcgacccctgccaagtacaagcacgttggagaccgcaacgcccccgctggtgctttggtcttcttccagggcggcaagtacggccacattgccatctccactggcggtgccaacgtcatctccactgacattggtggtgccggtaccttgacccgcagcaccatcggtactatcgagagcaagtggggccaggtaaatatgcagtgttcaatcacacacatgggtccctttgcttacaatgatttcgctgctaaccgatataactgctctgcttactcgcttcgatctcatcaatagacatacgtcggctggaccgctcccttctacaactaaatagcttttagtagcctgatagaaatggcgcactggttcctgaacagctggcatgggcaggacttgaggcgactaacgggaaagcatacgggacaaagcacctctactttataccaaacatcaataccaacatagttagctatcaagcgatcagcacctttagaagatcgcttaagcgtgtcctagcgacctataataaaatccacaaaagcaaaaaaaaaaaaaaaaaaatattcatcgtgtatcaactggtgagatgaataagagcgagtggttaaggatgcctgctgtctagaacggtttacttcccatgcgaagcactcggcaaccgggaagaggacagaggtttgcggtcgctcatgatcaatgcctccacaggaatgtagtttagcgcggagtttgactcagccaggaccggttggtggaacgtgcgcccgcgggtgacgatggtcgtgaactctcactctgaatgtgcttgtgagccaggacggcaagcgagttagggatggatacgtggagaacagagcataggcacgcaagcatcgatcctcgcgacagaaacgcacttttttgctggctggagttagtgctcgcagcgagaaaaagaacaaaagcgacggtctcgaagttgtgagttcgctgtcgaaggtgttgaaatgagcaccattcccactcagagggaacaatggcaaagctgatgcacttactctgtggccttgagtgtctagcgcggggctgggagtgaaagagaggagagagacggtacgtaggcgagttagtcccgagcttgtcattttggagaaaagtcacaatgggcaaagtcgaacacgcgagaaacaacgacacaaacgtaccttttccgccagcgcaaagcagcagagtatgagaacaaaacgagacggtgttgaagtggtaagtccgctgtcgcgcctgtcgcgcctgtcgaaggtttgtctgtcctgaaccttaaaaaaaggacctgcagtgcgcttgagaggtgcgccatctcctgaatacaggaatcacactatagagacgacttaagtctacagtgccagtgggcaaaatcaccgtgtgaacagcttgtccattcaaagtgtgcatcttaaaggtgcattctgattgtctgtcctaaatgtccatcgtgttgagtgtgtgtgtgattggagatgcagttgatcgaacgtctagttacggttggtggtaaaagtcagattgcaattcaagtcgttcacctgcctctaagacctctaagacgggcttgatacaaccacgattggtttgagttcacagtgttcagtctgagcttcaaagaagcgcgggcggatcttcattgccgtgcccagttgggcagtaccatgcctcagtacacccacgacaaccgatagctggtaaggaaaaagtggatgatcgcgaggtttatttgccgcatccttgttcaaaccagcatcgacaagacatggtgcatgcaagcatgtgtcgcatcgttgtactagtggcagctgagggcttttgtcgaggatagtgagtcaccaccaaagtagaagaatcctattcctgcgccgatgaccgttgctgccatgagataggcgttgtaggtcatgaagatgagcatcagaaagaagccaacaaagacttgagccatgtaaaagagcgagcgggtaagttggtgctggttggaaagtctaatatcgaggagcacgcaaggaaaatcagtctcaatcaaagcagactggcggtactgcacatcagcgaggcggggaagcacatgtatagccatagccagtaatacaaacctcatcgtcgattgcctggctggtaggagaggcgtctcgtcttcagcgatgcctcctccaacagcacgggagggctcggccggatgcctcttccgggccccctcgatgagttgttcctcgtagcggcgagactgagcccggagcagttcgtatgaggcagcgatggcgatgatgaggatgcaggagacgatgagcgcgatggggctgttgattttccaggactcgaacacgacgcagaggttttcggtcgaccagttgaagagcatgttcatgctgcagctgccgtctccaccgtcgtgccctccgccgccgtcgtgtccaccgccaccaccaccgccaccgccaccaccgtgtcctccatcgccgccgtgtcctccgccatgatccatgatgctagtaggtattgttttgctttggtgtctgggggcagggatagcggtgaaagggtaaggggaagggaacaagagagaagggagcaaggtgagaaagggagcaaggtgggaaaggaaaatgacgagaggggcttcttaagggcgtcgcgacagttagtggaaaatggcgagctgctgacgggcgtttctctgtagaacatttctcgactcacacactctcaggcaatcgatccagccattactccaggactacggttcacaaggcaggacaacatgctgcggacggagaacattcatttcagaaagacaaacaaaaacaccgtcgtcaagagggtccgggaaggtatacaccaacagtctggattccacagcatgtattcagcgactggacaatgctgtagaaatgaacaacgcgaccttctaaatctccgtctcgttcttcgcaatggctcgcagtctacttccgtacagatatcccgtgtctctcgagtcagtgcacagcagagacaccctgtcaccaacgcgtcaaggtcgaatccagtcttttatgctcagaaacgccctattttctgatcccggactattcggtacgatgagtctcaaaacgcggaagtcagcggcaccagcatcgttatagctgcgcagaagtttaacagtcgtactctgctataggtgtcactgcgatatgccgagttactggaacaggaagagataaccaacatcatattcacagagaccgtccttcaaagggtaacgcaggatcgttttttacaggaggaagaggtgcgcagagtcgtcagaggcccgccatgctcacctagtcatctgaaaatccatcaaacagttacaaaatgaagacaagtctaggacgtataagggcttgcggcaggtcaccagggatccccggcgcaggagtgttgtctttagtaatgagcactgtgagggaacaagtgtgcagcgccaaccacgcgaatcgatcgagcatagagattggagagccttggttcttacagcacaatggtaccgacgtcaccttcagaacagtgtaccgatcatcatgctatctgagcaggtaagcaaggtgctgctcgatggccactcccgtaacatgtggtcagcaagttctaaccattgttaaaatgcatcttgttgtcgagccagttcacacaggaggatgttgagactgaatccagcggtggaatcactgttacgacgctcaaggaatacctgacgacattctggccagcaaatgccgtactccacgaactattggggtccctcaaagaggccatccttgaagaggatttggagaatcaaggccaaaagagcttggggtccaaaaagaagtcaggaactggataccaggaggtaagttgcgacagcgtgccgcagctggtgcttcccatggacggaatcccggacgacatatgctaaatttgaacacttgcactacgctagtacaaacccatgtcggaactggaggctggagtcaaatcacagcgcttcttccaaggtgtcttgaaagtcagggctaatcatcgggaccaggctttcatccgtggtgactcggacattggcgaaattgtgattgttggatcagatcatcggaacagggctgtccatggcgatattgttgttgtggagctactcaaacggggctcctggatcgcaccatctaatcacatatcctatgacccggaggaaatccacgaggcagcggacagtcaagaggacttttcaaactctcgccggtctcccgaggtgaagcccacgggacgtgtcattggtgtaatctctaggaactggcagccttacgtcgccacgttacaagaaggagccgagaaagattcaggatcgtttcatttggtgctacctctaaacccagtgattccaaagatcagaatccgccaccatgacgccaaggctttggctaaccaaaggatcgttgttcggatcgacagttggccagtgaattcccaataccctaatggacactacgttcggagcattggtcccacgcatgatctgaataccgagatctctgctattttgatcgagcacggtatctctgtttctcagaccacgcaggggttcagtgaggggtcgctcaaagagatgcctatcaattctgtggaaaggccgtggacaccagagcctgcggagctgagtcgacgccgagatctgaggaggcacattgtcttcagcatcgatccacccaactgccaggatattgacgacgccatttcgatcagggagatagggaatggccagctggagtttggagttcatattgccgatgtgagctacttcgttaaggagaattctttgacggacttggaggcaagggaacgaggaaccacagtgtatctgtcagatcgtcggtttgacatgctccccaaagttctgagcgagcaagtgtgctctcttcgtcaccatgtggatcgctatgccagtaagacctgatacttatcaagttcgtacaactgttctcttggaaaggctgcaaaacttcttacccaacgtcatttttttttctccaacagtgtcggttatgtggacattggatgcagatgcgaacgtagtggacacttggtttggtcgtacagtgatccgctccgcttgtgaaatggaatacgagcaagcacaggggttactagatggtaaggatgtcgttccggggttagacgcaaaagtgtgcaaacagctcaaaccagccgtcgtcctcctcgcaaagactatgcgcaaagtcagagtaagtgtgttgtccaacgtgccaatgtgttggcggccctttataacgtggatacgatcagacgctaacgatttgtgcacatttaggcacgtcgcatggccaaaggtggacttgagctagaaagctccgaggtcaaattcaagttcaaggaggaggctggtggtatctccgacattttgcccaaacagccgctggaagtgcaccaaatcattgaagaagccatggttatggcaaacggacacgtggcaaagcggatctatgatggtttcagagaatcagcaatgcttcggcaccatcccccgccgatcgaaagccatttcaaaatgttgcttcgagctgcagaaagcagagtaagttcttgctcactttgtgccttttaagcactgacaacaatgagcatctaacttaacgttgtgtgatattggttatgtgatctcttagggcttctcagttgacacgagttccaatctggcccttgctacttcgttgaggagctgcgccgcaagaagccaggacgaccctgagttcgttcgtcttttgaagacgatggcgaccatggcaatgtcggaagccagctacatttcctcaggctccacctccatcgacaaatatgcccattacggtttggcactggacttttatacccactttactgtaagtgtgtacttgcatccagcgtttcgtatctgaagtttgataatatgtgctaacccgatactggcgaatgtacttgttagtcacctatccgtcgatatgcagatttggtggtccatcgacagctgatggaatgcatatcgaacgtggcagcatcatctctggcggcctcagagcttctcaggaatggacttaaggtggccaaggttgctgaccatctcaactacaagaacagggaatcaaagctggcccaaaaagactctactgagctgttccaaaccctttatgtgctgcaaaagacgcggaaccccgcagcgacaggggataatgatacggaggctgaggatctgccatttgtggaaacgggaatcatctcggagatccgagagaacgggttctttgtgtttgtgccacgattcgggatcaagggaccggtctatttgaaggaaaagtcgggcgagattacagtcccgctctcggtactcaagaaggctggcgaatctgcgtcgtccgcgggcaccaacggggatcatctgcacttgatctcaggatgtgagatggacaccgatcttgtgacgcagatatctgtcaaggtcccaagtcaaatccttaacgcacactctccaggactttccagaatggttcaatttcggctttttgataaggtcaaggttgcgctgagactcaaaaagtctttagcccatcggcacagtatttacatgactttgattggcctgcagcaggacgtttcctcaacgtcctttgcccatgttgccccgcccttgagcgaccgtctcttaaagaaagacgaactcacgccacaaaagaaaaacgacagaatcaagcacatcgccgagcaggatccagctctatcgccattatcggagcgtgaactaattcaaggcattcagaaaggggaacaggacgccaaagcgtcgaaaaagaagacaacgcgcaagaggcctgtgactgaggaagagtcataccagcagacgcgtccggatgccagtctgtacaatcttatcgagtcctttgaacgctgccgcataatagaatcccagcagtcatgagtattcaaagaagacaaaaaaatgcccgagacacagtgtaaggagaagaagcacccatctttgatgttttattgacgtgtcctcgtgaacaagagtactcgaacagatttaagcctcggttctgacgcgagcgttggcgttggtgacgcggatgttgagctgctgggcacgctcgacgatggcgatgcggttgcgggacgagacgttgtgggcaatctcggcagcgaaggtgcggttgtgcatcaacaagaggttcaactcggcgatgttggaaacgaggaacttcttgaagccggagggcatcaagtggcgggtaagcttgttgttaccgtaaccgatcttgggcatggcaatctggcccttgaaacggcgacggacgcggttatcaatacccttgggctttctccatgactcctgttgaagggaagcagacccaagagagaagaggtgtgttcatgttagtcctgtttctgagacttcattgggctgttctctctgcagataaactgtttcccggcgcttcataaggtccagtatttgccgacgaatatgatactggatcgtggtgtttgctgccgcgagaagtccaatgctgggtaagattgcagcttggggacagcacagctggtagaatcaatttggggactctcttgtgctgaatgatcctgcatatcgtccgtacaacctattcaacaccgtccttgttttgcttccttgatggcaaacaaccgttctccttgatctgatttcatataaacgtcctggtgatgttccagtcatcgtaccttgacggtcttgtagcggtcagactggtgacgcttgaaggtagcggtgtgcttcttcacgatggtgtgcttcttaagaggagtgaccattttctattacggcacgcggtgaagacaatgatcagttgctgatttcgagattgatcttagctctgtttctgtaagaccgattccggtcgagtcctgatcctggtgactttgctggtttcgagtcaaacgtccctgcttgaggttcgagggcgttatagagattcactggatcgaaggctgtcgatctgccgagaatacatgaaactctgagcacaatgacttccacctcccagtcaagcctgcagctagttgatccatcgacaaagtccttacgatcccgcagttgtagaatgagtgctcaagaattggtgcagcgtttcgaatccagatgctccatgcattatggtacgataaagatttgatgcaactccattccagaatccggttagtttctgagattgttggtacactgggtgatctggtgatggcgtcagaggatgaaaaaaatgggcatggtggatcctggacaaaagcgttgcctgggatgcgaggatggcgatggatcggtttatgggcgctggatgggtggatcgatgacttcctgcctggatggatggctaggttgcttccagcggataaaacacatacggataaaaattgcaaaagagggtttccaaaccgctgcgcgtcgcaaaaaatatgtggtgaaaggaccggcccaagccacactatccggccgtacaggtggcaagacaaaaaaaaagtagcgagggtgtcggaggtgcatctcgttgttctcttacgctcgctgttcgtcctggctgttactccagctagcccagtctgcccttcgttcttcctgctgcctttcttgcctctatccctccagtgggtctcttgagtgcaaagcaacatcctgtctggaaaaaaaaaccagacaaagtagtgcgagtctcgaccacattcatacacagctcgctggacgcgcgtacattgccctgtgcccttgtagttctcggaccacccatttcagacacactaatgtcggacacagaagagtcaaactcgaggaagcgtcctgccgactttgacgagctgtttgaggatggcgacgacacaaaggcaaactacgaatcggaagacgacctcgtggatgaggatggtaacgtggctggagacttggacttgacaaaggctggaactcaagcctggctggtcaaggtagcagaacagacacaccttatgcgcttgactgttgaatcgtgaagatagaaaaggggctggcctcgagtttctcgtccgttgaccagagctcctgaaaactcaactgtatcgttgtgtaggtccccaagttcctggctgaacgttggtctggagttaccaagcacggcgccgaccttgggaaggttaggatattcaaccagtaagcatcctagtgctgcctgatttcagacactgctctgctcctacctccagtgaattctaactctgagcttccttcacaccaagaacaaattccagtgaacccgtctccgcacctttccagctcatccttccatcagacgatgtcacctctggccttcccaagacgtactctctcaacatgaacaccaaccaggtgacagatacctttgtctttgcagaaccaacaggcgcacacccaaaaccaccccatggcccaggatatccaactggtaaagcgacagccatcctcgccaccatcaagcacgagtgtgccgtaacaccattcccaggcagcgaggagtacaaggaaatcatgagggagcgaaatgtcgaggcagccaagaaaggtggccggtcagtccaaattctgggagaaaacaacaaagccgatccagcgggcggtcgtggtggcatgtttttgccaggtgttggcatccgtggcggattcattgtaagttttggccatggttgcttctgcgattgactactgatagattatggcattctacagtgcgttaaaccatttttctgatcccactgatgtctctcttgcggttcatagcaaaagaaggtcaaggtgcaaatggatcagaagacaacgcgtatgcccaggaacgagctcatggatatgctttttgccgcctttgagcagtacccttattggtctttcaagggtttggtagagcatgtcaagcagccgcattcgtacctaaaggaggttttgggagaaatctgcaactttatcaagaaaggaccgtacacagctaaatatcagctcaaacctgagtttgcaggtgcggccggacgcgctgcggctcaatcaggtgccggagcaggagcctcatcaagctctggagacggtgtcatcagcgcggaactcgagacaacctttaatcctgcagccgtgggcgtcggctccggtgaaacggcgacggcagcagttgatgcggacctacaggaggtgttggacgaggatgaagatttcgacgaggatgaggacatggaagagatcgttcccgtatagacccgttatctttttttaccactttttttttttttttttttttttttttttcttttgttttctactttttttttgccttttctctcctgccatcgcgttcttcgcctgcggccttcataggggtcatatcttcagtccgctctcgcagtctcacttcaaggacgacgcgtcgaccttttattgcaattgaatcaccaacgccctaaacgagggcacccacagtaaaggaaaggaagaagaaaaagggccctttctacaatactcaaaactcgttcagacaacgagtacggcgccgatgatgaccagagccaccatggacacaatatcgttggcaaagcgagcgcgtgcgctgctgggtgaggctcctccagccttgtcagccttgtcagccttgtcaggggtcgcggcgcccttgtctccggcattgggcttgccgtcgacagttttctttgcaccagcggctggggcggtcttgggtgccgaaggctcgtcagtggttgcatcctggatgaaacccttggtcaaggagccgtggatggagttggtcaactcgtggttggcggtatcactgtccatggaccagatgcttacacctccgaaaccgtagtttttgagatactcgaccttgtaagcaaaggtctcgggggtgtcaaaaccgacccactggttgccattgaccaccatgtacatgcatttgctgatctcatccatgcgaggagctgtcgtgacctcgcggtggaagatatcggcggcacgctgcttgaagtctgtgatcttgaggttgttggcaagtttcttggactcgaaataggccatggcacccttctcctggcaacctttggggccgggaccgatggcgggtgagccaggggtggtcttttggccgtccttgagagtgaacgtgacaccagaaagggatagtcccaggttgaacttcttggggttgacagtctttggggccatggaggtaatggcatcgatgagtgagtagccgtagtagggagtgtccttggcggggtcggctaggggggcggcgcagaagacctgagcctcccattgtctgtgcagtagaaagagatattcgaatgcatgagatggctagtttgtagcgaaaagagaggtatacaaagagcgcgcagacatatgaaccccgtctgatacccacccgtgcaagttgtaggccatgatgttgaaccagttgactagaggtcggtcacatgaggtgaagttagtgcttgagccagccagcaaacgacaacgagaacagaaaagagcaacttattaccataaggggcgagcttgggaacgaggaaatatttgccgtggaagggtccaccgggcaaggcgatgctcaaaatcagacgttcctgcttatccttgagctcctcagcatttgcagcctctctcatctccttcatgaaagtgacaaagttctttgggtcatctggatgacctcctctctttggatcggaggggctttggagtgaagcgcaaaaaacgaaactcttagttggataaaaagcaggctgggttaacaggtgtgcaggagggagtggactgtggtccttactattcccagtcaaagtcgatgccgtcaaagccgtgctggcgaataaaggcaattgcacccttgatgaacttttggcggctctcgggggtcgagaccatctttgagtaatgcgccatatccatagcccagccacctttttgtttatggtacgacgcgaggattgaatgcgcgagttagagctgtggctatcatccagccataatgtacagcaacagccgataatcttaccgacagtaacagcagtgcgtagagttggcttcctgagtttgagagcgttaatctccttgtagatggcgacgtccgactcatcctgcatggcaatcatgccgtccgcgttgagcatagcgaacgcaaaattcaggtttgtgtacagatctatgggcagatcctttggttcgaatgaaggataatccgggcattctcccgcagtcttgaaaggaaacaaatagcaaagatggttggtcaagaatctcgcgtctcagtttcggatagaccagtgatggcgcaaaatcacatatgggagggctacctttccataatatccaacgaagcgttgcgcttccactagtgcggggaggactaaagccagccccgcaaatacgcgtggcaatttcatgagggggaaggagcaaagaacaggtggatacgggttggcaaggatagagaaggcgggggagatcaaggatcgtagcaaaaaaagaaaggaagcaaagctagtgaattagaaatccataagcatatatctttgggaggagggagaggatataaaagctgcacactctagaaggattcggaacaagcagtctcgttcaacatatttcttcttttttttttcttgtttcttcactttcacttattcaaggtcctggcttgctaccctcggagggcattggaatgaaggaatgataaccctagattcagcgatccaatggctgaaggacgatgcgtttagcctttcattccctaatggcccaaaaagacctgatcagagacatttccaggttcgcctacgttcaactggactcacgcttaacagaggaggattgagaatcccgctttgttggctgacggcatgccgcgatgttcaggaggcaagacgacgcgtcaacggctcaagccatttagcgttgaattcaaaaaaagggacaggagttgcgtgccgtggggctgcgcttaggccattgaaatggacaaggctctgacaactttggccagtcagcgtgcgtgtacaaagcaccagcaaggtggatagctcaggcacagcgctggggaggtctgaccccaacgaaacagaggcactgatggcaggttgcacaatggatcaaaaaaatcatcatgacgaagccgcaaaagtgcaaaaacgaccacttgccgtacctgagataagacggccctcgcgtcacacccctctggcattttgctcagcgttttcttctcgttgtctcaattctccgtttctctgttccttcgttccttactttctgccccgtcaccaaaagtacccctctgccttgcagtagtcccctcaccctccttcatcctcctcatccggactcctcggatcctctgcttatccaaatgcagtaccactctcaagccagcgtgcggaagcgcctcgactactactaccgtgcggtgaacgcggtcatcctcaaccgtcagaatcccaccactggcctaatccccgcttcggtcgctgtgactacccacggtgactaccgtgatgcgtgggtgcggtaagagataacaaggcggctggcaggagcaacggatcgcaacgatgctgaaaatagagcttatccctcgcttttttctccccccctgtaaaatgatcaacagcgataacgtgtactcgatcatggccgtctttggtctggcgctggcttaccgccgagtggatgatgacgaaggtcgcgcttgtaagtacacgtcctcgcatcttcaaaggctatcgtcatgcttcgttgaccccttatttcacggtgcacggtgtgcgaggagaactgcatactattgagataaccctcacaaccacacttatctcagaggcgtgggtaattccgcccctgaagttacaacttacgcccgcgttctatctgacaatacacgcaataactgtagatgaacttgagcacgctgttgtcaagttgatgcgcgggctacttttctgcatgatgcgacaggcacccaagattgagcagttcaagaagacccaggggttgaacgactgtttgcatgccaagtacaacacggccacaggggatactgttgtgggtgattcggaatggggtcatctccagatcgacgccacctccatcttcttgctggctttggcgcagatgactgcatccgggatgctcatcgtctacaccacggatgaagtggactttgttcagaacctggtcttttatatcgagcgcgcttatcgaacacccgactatggcatctgggagcgaggcaacaaaatcaatcacggtgagcccgagctgaactcgtcctccatcggtatggctgtcgcggcacttcaggccatcaatggcatcaacctttttggatctcgaggcggacccagttcggtacggtttcatgactagattttttttcattacagtggctgcattgcgtcttttcgttgttttttctttactcataatcgttttctggcgacttgttccaggttattcacgtcctgcctgacgagatcacacgcaactacaccacccttcactctgcgctcccgagagagtccaactcaaaggagattgacgcggcgctgctctccgtcattggcttcccagcttttgctgtgggcgatgcaaagctcgtgaagcgcaccagggacgagatcatcgagaagcttggcggaaaatatggatgcaagcgtttcttgcgcgatggacatcaaactgttgtggaaagtaggtatactaattgcctgatatgactgattggccttgctgctggatcctcaatgaatactgacgatgtgcaaactctgcattatagacacgacacgtcttcattacgacgcgcacgagctcagggtgtttcagggcattgagtaagatactgtgttgtttttactctttactctccttccaatcttttgtagtctcatgctaacgctcgatttcatttgatcttgatagatgcgagtggccgctgttctttacgtactttattcttgacggattgttcaacgagaacgcggatcaagtagaggagtaccgagcgaagctagagccgttgatcatcgactcggccacattagtggactttggccagtttctatctgatgcgacgtcaggaagcgacgacggccgtggcttaaagactcctacctcacctggtttcgctacaccgggcagtaacagcgagggcaagctacctgagcacattccactcattccggagctgtactatgtgcctagccaccttgttgaagccgagaagaagaataaccatacgcaggctcgtatcgccaacgacaacctcccccttgtgtgggccaattctctgcatactctcggaaatctcatctatgaaaatctcctcagcgtcgccgagatcgaccctctgggcaggcgcttcaatgcgcgcaagaccagctccaacgacactgttgttcaagttgtattactggccgaggacacgaacttgcagagcatgctgaacatgtatggtcttgaaacgcaaacgcttgagcaggtccatcccatcacagtcagccatccccaggggctgaaggaggtctacggggccctcggtcgcaatgcaaagcttgggttgtctgggcgtcccaagagacctgtcggatccctcggtacctcccgcctgtatcgcgttcagggccacctctacgctttcacacctcacttcatggacaacgaggagttttatctcaccagcgataacgactacttgatctccatctttgagcaggagttggcgtttgttcggcagtactgggagtaccctggcagaccaaccatggtcgtgcttctgacccacgccatgctgggtgggctgagcaagtccagggcgtttgcctcgcaaaccaacacagatcctcaacgcctgaccacatggagaaagtcctctttggggtcgagcccccacaacaacaagaagcgcaaccttctcaactttttcatgaccctgcgtagcggcgtttgcaacaatgttcgcgtgcgcttgggacgattgagcgagatgatcaacacctcgtgcatcgagtcactcgatttcttagtcaccaagaaggacattgactggctaggcattctccgtggtgctgccgatcgtcgtaagggtcgagctgctcgcaagcttggcctcaacgagagacagacacaggcggctacaccaggcgccacaggcagcagaacacctggaaaccaccgttggtccatgcgacgccattcatctgtttcaggagccgggatctcgttcgcgtctctgaccactcctgcggtcaacaacgaacttgaaggggatgcttactttgggtctcacacacgcaattcctcgttgagcggaccgctctctcctcgtgcctcaacagcagatccttcggaccccttttcctcaaagaggtataggaagggacaggccaaggcattcaagctcaaggaccatgaggagcctcgtatgggccgcaagggtagtggtgccgggatcgcttcgggtatcgcgacacccgatttgaatagcctggagatttcggaagcacctgcagctggatcgtccttaggaagcacagcctttcccctgggtgacggcgaaggcgaaggggagggcgaaggagagggagaggatgaggactcggacgaagggtcacccgatggtagcatggagagtcttggacttacccttggagatccctcgagcatggaggcagcgcagaacatgctgtccatctctgtcaatctctatgatcaaatcggtatgtcgcctttccacgcatctcatgtcctcttgttgctgctctgatttattaggcacctaacttttattcgtcgttgttgtagacctcttgcaatatttgctctcgtgccaaggaccagattatgttgtcaacatccttgatgccccagttcagaccctactcgaagaagtctacttcaagtctcttcagctcaagttgtggtcgatcgtccgccaagcagcaggacttttggacaagctggtcaattcactcaccatcaacatcacagatctggtcattcgtcagaaacaagtgaccatcggctctgggcccactgagcacttcatcaccagtccccttggacctgatgttctgcgccaaatgatctacgatggcaactttgacgatgtgcgtgagggaccggtggttcaggaggtgttgatctaccttggctccttcattagggccgaccccgatatgtttgagggtattatgcgtctgcggacccattttttgatcattgctctgcgcgaggagatatcccgactcaacaattgtgatgaaaccgaagctgtcgaacacttgatgcagctctcaccctttgagctcaagtccctccttggcacagtcctgtcgggacctaccttgagtgcgaacgctactaacacacttctcggcaaccagtcgtctggtcgattgagtcccaccatgtctgggcgccgtccctcgaacagtggtcacgcgagcggcgaaggcctcgatgccaacatgactaccaacattgcatcctcagcaggctcagtgtccctgggcgcgattcctattcccaacatggccaagacccctaacgctatgagtatccaggtccaatctggcggatatcactcgggttgtttctcaaagatcttgatcaacgagagcactctgtcggtgtcgtcacgcggcatcaatatggtggtggtcgatcccgttcaaggtgtgcttatcgagtcagtaacttttgatacccatatttcggaggatgagagcgatgatctcgcgcggctggtggactggctacaaccgggaatggtggtcatttgcagtgcaaaggacgactgcttcgagcacctgacgacggctgctaaattggcgctaaagcaactcggaagtgagcacatcgcggacctcaagtaccgagactcttggtgcttaattggcgagaaaggtatgcatatcgggaccctaaaccgtttctatttttttttttttgtgcatctgttttttgtttgtaccaaacactgactgccagatttttttttgtgttcgttggaccaggcgcagcaccgggtgtggccattgaggcgcatagagctttcacggatgggcctacaccggtaattgagaagacggtggatttgaatgaataccttgccaaggcaggtgcagaggatgcgttcccgtctccctcggccattgcagcgtttgtgcccaactcttcaggccgctggttgcgtcggcgcaagaatgacggttcgctcaaccgtgttcctgacaaattttacccgagggtgtggcacatcctgtctcgatctgccggtttccgaatcggttcacacgtcctgcctcgggatcccattgtgtccgagaagacgcccgaggagttcaactttgcgttggcagtggagaactttttgggcgtgattctggatccggcagagcgacagatcgcggtcgagacgttgatggtgattgccaagattgaggaccgtaacccggggatggaggtgcttccggaggtgattgacttgcctctgatcatgcgtgaggccatgagcaagttttggacaaagtgggtcgttaatggacctggaggtcgaggacaggccgttcctggtggtgcactcggatcgacctcagggtccaaagcaggagtgacaacggcatcctcgatgcctgccaccgtcggagaggttgggtttgagcaccatgaaaatgttgcgagaggcatgttttatgacttgcctcaagagggcaaggaaggcacctttgcgtatctggcgcgtgcagcgctcaagctgctcccgtattccatcgatctggagtgatggaacaatggttcgatgcggtgatgggtcatagcaagggcaaagggacgagaaaagaagaataaaacaaagtggccaaaggggaacacaacggtgacgaggaatggaaccaaatgcgatgcgtatatcaaggttaaccagagcatgcttccgtgttgagtgctccatcgtcctgcctgctgtgaagaaaggtgaagctggatgggagcggcggtctggcctggccacggtacgtgccctggaagaccaggagcaagggcagacagtcaagggaacgcgacccccttccgtgccacttgtcccttgctctgggtggcctccatctcgctctctgctgctactgctgtctccctcagtctaaccctgccgcgcgactccagcgctcgtcatgcgccgctgctgttgcaccgactggcaacagcacacctgccctatctgcgcctcctacaggggggcgcacacgtccccaattaggcgttcgtctccctttcttttttccccctcgtggacgatggtccttgtcattgcacttctccactgtcaggctgcattgtcctcggaccatcagaggaattgacatttggctccatggctatttttactttttgttctgttcgtatttggtgaactttctccgagacgacgttgtgcctgagcgccgcacaactgctcgcaccagcaggcaatccaggcacacaagagactggactggactgggatgggatgcggggacagcaggtgtgcacagcccaaaccagagagcagtaacagctgtgggctcctgcgtggcagtggcaacaacggcacctctgtgtacggcggtggcggcgatctcgccaggcctgaaccgcgcagatcgaagctgttgtgcacatttggtggcaaactcctttcccaagcgtgccttggccgtgcaaggtgtgatctctcctgcctgcggtgctttctttttttctttattttttcacacctctctcttgtcctctgcattccatccacctcttcgctgtgtccgtctcgtcctatcctcgtctctcgtgctctctctctctttgcttggtcctcctctcttccgatccccccatcgacaatcgaccccagcgcgcccgccacgcccgccttccctttatcgcgttcctcaccaggctaaaataaaggacacctccacttcctgtgccctctctttcgagctgcatcgatcgctgatcagctttgcagatccctgctcccttcggcgaccaccttggggcacccattactgtgcttcgtgttggaaagtctgatctcttactcctcctcctcctccatctcctcctcctcctcttgctctgcctctctcgctcctaccttgccctgcgctcactttctttcccttagctcgtttttttccttcgttgcatttatttattttgtaccccaagttgatccttgtcgttgcttttcgaacagagcacacttactaccttgcatcattatccaatcgataccctgttactaccagcatctagcaaaccacactgtgggtcctgactatatattccagtcaacaccatctgttgcccttcccatttttcttcactccgctcctccgcctccctttttcctcgcaaagacaccatgttagcccacaacaagcacgccggctatgtcgaggagccagagcatggccatgccagattcacgccgcctcagcccctgccccagcccttgcagccgtggtggttccgtgagcacgctgcatggggacgcccttcagaggacgagcgaggacctggcgcgcagcatcggaacgatcacctcaatcccccttcagacgatgatgtctcgccctcatcaatgcattccagtccagtgtgcagtgagcggacaggatcgtcggccacagaaatggcatcgatcaccattcacccgacgatcgccaacatggtctcctctcctgcctctctttgctccgctccctcttcgcctttacagctgtcgcctgagcgtgcccttgcccctgccccgtcgtctcctccacatccgtcctcctcttcatcgtcctcgtcctcgtcctgtcccaggaatgtgtctgaatctctagagatggaatcgaacctgcagcaatacgatcggcatcctctgcctcattatcagaataagcatacgctggcgacagagaggcgtcccttactatcatcgccgctgccccctcctcctcctgctgctgctcctgctcctgctcctacttcttacgcaacacgttatcgtgacgagatcatgatggacatgacgctcgaccatcctaccgtcgcagagctcacatcctcgccctcctcagactcaaggatggatcactgcgaacctgaatcacaaccgcaggtgattcgtgggtggtcgtggtcctcttcgtcatcctcctcatcaacgacgcaagcccacagctccccatcccctcccgttgacccttcatgcatgcgatctctgccccatcagccactagcagtgtcgtaccaccaccacaaggatggcgagcagcaacagcaacagcaacagcaacagcaacagcagcagcaggatgcagctctgcaacaacggcactatgaacaaggacagtaccctgatcaacgtacttataatcatcagcagtactcccaagctcctccttggcctgagcatccactcaaacaacagcagctgcagcatcgcagtcgtcaagcttatcactcgacgttgagggaatcgaccgtcactgctgggccgagctttcggcagagaccgccgtctacagtctactcctccaaaaagtcaagggcgagccccatgatggcctttccagagggccacagtgtgaatgcgaccaccccacctggactgccgcaaaggaaatcctgtccagcgatctcaacctcgtccagaacaccgacacgagtgcggccttcctcccacggaccccaacctctgcatccggcactggtccagcgggatcaagaggaaggtgattccaattcccctccaagaccagaaagtgatcaacggagacgatccatagccctgcccctgcccaggaactacgagtggatgagtgctgcacaaaagattctgtacgagcgacatccgccctcgcccaagaacgagcggacctcagcgtcatccacaccctctccatccaccactgcttcctcccatccgtcctcgccctcctcaccgtccagtgcctcggatggagggtcttgtccatccacctcgcctagtcggtccatgtccatgtccatgatctccaacgacggagcagacaggagcactgaccaccaagaacagtatgagaaactaccgcctcttcttcaggcttacgagtttacgtctgaacataaccgtttaccggtcatcggtcactacccaccgcacaaacaagaacaacaacagcacagtcattatcaaccccaccaccaacaacaacaacaacaacaacaccaacaacaccaaccgcaacaacaactacatcatcctcatcaacagcaacaactggagcaccctgagagaccagggataccatttcaagacccaccgccaaaactaccgtcgctctcctcgttcgcctttccacgagcgcgtcctccacaccatgctcagcccatagagtttcccaaccgccggaactcttcctcctctagagggctcacctccctattctccacctcctcctctgctatgaccctttcctcactatctctgacaccagctcccgcaaacaacggcgtcaccaccaccaccaataacacctacaatggaccctttcaacccagagacgcatccaggacaggaggccctagtcgagatctgaagaggagcaatagcatgaccggtagtggcagccccagccccccaagacccgtgggccgcgaggccttacccctgatccggaacgaggacggcaccctgatggtctacaacccgctgacagagtccatgaccttccgttgcgaactctgtccaggcgagtcctttggacggatccacgacctcaaacggcaccagacctccaagcaccaggaaatgacctggccctgtgatttctgccaccggccctttgtccggcgcgacgccctgctgcgacactacaccgtcaaggccgccagagacgatggcctccatccggcgagccacgaggtggagcgattgctggcggcccgcgctcgggccaagatgttatactgaccccatatggagggtttccacccctatgcatctctttttggctattattcgccaagtagacacaatagaataagaaaaaaaaaaaacaacccaaacatttgaaacttttgccaggtttatgcgctcaggtcttcaatgtcctgcatgatcctgtcgacaaggcgatgggtgaccaacaacgcgtcctgcgccttccgtcgttgccaaaagaccgtgcactccaaactctcgcatgccaccaattccgtgcccgtgttcactgcaggcccatcgacttcgcccacacccacgccgccgttcggaacaccgcggcagcaagagctgcacacatccacggtcgcccggaacagcttctcggccttggacagcttattctgcatcaccagcatcgatcggacctgaccctgctcgctcgtacattccgcgcacaggtccttgttcagcttctgcccgacgatcaacttgctgcacacggcgcacagctggctctggtagtatcgatcgatcctcgacccaatcgagacaaagccctttccacccttgcgcttgggcttgaaccgcgggggtcccgaaagcggatccgaggggactgtggccacgggcgcaaagacatgcgatgaagcagcgagtccagcgccatcctccagagcattgcccatctcgagatcctctcgacgctgctgtgctgccaccacggctgcagaggactcggttgggatgacggtcgctgcagttgcggtcgaccctgtaggtgacccagaggcggatgttgatgacggttgacccggtccaggatgggccaatggcacagccctctggactcgcggcatttcttcgtaccacgatttgacatcggctcctgcaagctgaaagatccgttccatcgaaggaatgatatgtttccggatgtagtactcgccattcaaccgcagatccttgttttttaaaagttccttgggttcgaccacctggtctgtcagtcgagcgccagggtcgccatagacaacgacgtacgggacacgctcgccatattgcggttccgagcgtggatcgagttccatcctgcgcgcagatacaacagctcccgggggtggaacgcccttcaagctgagcagtgagaaggaacgaggtagcaaggagcaaaggcggcgtaagacaactaagagctttccgcaaaagcgcaagaggccaagcaatgacgagaccaaatcttacctgtagcctcccatgcgcacttccttcccaaacatcaggtccggaaccggaatgcggccttccaatatcttgcctaactgtcgcacaaaatacgccttaaccagggatagatcttgggtcctgaacatggttctacaaaaaaacattaaagacgaatgtggcgtggcgggttcagcatgagcatcatacaacgacgacacgccgtcagatcaatttcgctatccttttttcacttacttaatacaggtctccataatcttctgcaccgcaggcacaccatcgcgtcgaatggtctcgatacccttggcatcaaagttgggttccttctggttcggcgtctcgtaagaggagcccacataccgcttcttcgtgaccaagaaacacgggtggtaaaccttctcaaacttgagcttgacgggacgcgggttcatcctcgtaatcgtctctgcaatatcgtacccaatctcaaaagcctcctggcgggtccgacccttgagctgaacaaacatactgtccgtgtcgccgtaaacgaccctcgcgttccatttaggacactcgttcacgaatttgatagcccgctccaacgtctcccgtccagagctgacaatcgaatctgccatctcgatgcccggcattcggccagagtatgatgctgatgtgtatccataagtgacattggcgatgaactttagcgagagttgtcgggtatgcaaaagcttgagaagcgccttgttgtcagggtattccctcatagcttttttgaccatcactcgtgtgtccaggagctcagccaacatccttgcgagcaggcttcttcgaatgtcctggttgacaaacatgacaccattgggcgcaactatcaaaacaacataatgattgaaaagggatcgatccgggtgagttatgcgatggaaaaaaagcgtagtgatgtatggtaatgcatggtaatgtatggcggagataagccaacgacaatagcgatatcatatgctcatcaacttactgtgcaaatgctcttgcattaacggtagcacaccgtcttggatcttataatccaccacaccaaacttattgccacctcctagcttccctaggcatgtcgaatagcagtagttgtacgcgatcataacgctcggatacaaactctgaaagtccagtaccacgaccggatcttcatagaatccagactctggttccatgaccatcgggatgacctctagagccctttgcccagcgacctgagcgcgactgggagaaatcattaaaaagttctctggcttggccagccgcaccatcatcgactcgaccttgtactgcgatccgcgcgagatgacgctgaaaaagtcgacgccaaagacacgtgcaaactcgctcgtgcgggacacaagctcttgcgactcgatcagctgtagcgtgtactgaacgcgatgcagataattccggataacccgcgcctggtgaactgcaaagccatccctccaccacttcgtgagcgtgtcatgcgtgtagtgcgggactctagttgaaagatcagtagatcagttatgaccaaagtactaaatgagtgctaacgtctttgattgaagggagcaagaacaaggagcaggccatttttttcacaaaacgtgttagcttaccgctgctgaagcacatggaatacgacattgcaaaacccgtagttggtcagcgctacctctccacgaataagtcgccagatgttgaacaggtgccgacccgcaaccttgagacctgtgtgatgtttgctgttgtacgagtctcgcgcatccatggcgcttttggtgaggacaggagccttgagaggccgtacacgggacaggagcttggacatgtccaaagcgaacagggtctggtaacgatccacaacatatccccaggaaaggttgtggacctcgtatcctgcaaggatgtccggatccttgctttgaacgtgctcaatcaaaacattcatcatcgccccttcgtcctctgctacatatatgtcgaatccagtgcgacccacagcaagcttcggtatcatcttggctccatgatgtgtaatcattcctacgcggtatctagcgcgatacattcaagacacagggtggatactgataagcatattgccgcgaaatatgaatgaactatagatacaaccagcaacttaccccggtacccatccattcgaaatcaagccttccttctctgtttgccagcagtaaaagaccgccaagattggatcaaacttggggtctggcagcaaaccaggacgcgtctcgcaatgcacttccagacttaggacatccataaagtccttctcaaccgccatggatccggcaactttggttgggctgttcttgtacccaaacggattcttttgcgttggtccctcaatctgtgagatcttttcccgccgctgctgagtcgacgcttctgctgttgatctcaactttgccttgactcgctcgcgctcctccttcagccatcgcttgacctcgctctgtgagggcggcgatggaagaggttcccaggacttgaatccattgcctggcgcagatattttgccaacttccaatccgccggtgaaagcccgcatgaatttgattcctttcgagggtactcgaaactccttgccgccaaaaaccttgacctttgaaggaacatcggcctcgttcgaaaaatatggcttttggttcaccgaaatcggcagacccaactccgggaacgacgataaaagaccctgagctgttggagccgcaagagagtactgaaaagcccctgatggtgaggacgatgggctgggtataaatggttgcggtgtggcatcccatcgtgctcctgaggtagcaggctgaggcggcgttactgtctttgaaccttggaggaacgaatcctcagcaagaacaactcttgagatctcctcggaagcgggatctttttggttctggcatccactgagggcagcgtctggttcataatgctgcgtcgcaggatattcctgctgccctacaaggctgtctttccgggcgctctgcaacgacgaccgaaccagctcaggactgcgcgagtcgccagacgaaatagagatgatggtttgctggcttgttaaagtctttagtgaagtttgacttgacggtgtcggcaccgctcttgcagggactaagtctggagaggtcgggcgaggtggggcatggaaaaacgaggggttggtcaggggcggagagggcgaagaccacatttcatccatcgatgccaaaaaatactcccgacctggcgacgctggctttggataatcgaattccatctttgtgcgagatgccctcgtcgcagccttgttccggcgctggaatggctgggataagatcttgaggctgtccgattcatcttgctcccccgcctcgatatcaacaatcgcgtcaagatccggcccggtggcagcaatgtcattttctaccacatcgtcatcgtcgtccatgatagggtcatcatcgtcatcatcaataatgggatcatctgacacactctggaccagtcttggtataggcttgatgaactctggacgggtgttcgcatgtgttggtctagcagcggtttgcgttgggcgctttcgagaggggacctccacatactttaaaaacgctctccgcgggggctgggtcgattcagaaaggtgagccgagacatcagggtccggtgttactggaggcgaggagaaactcacagtctttcttgagctcagacttgactgctgctgcgatgtcagttccaagggggcagtgcctgcaacggccgaccgtgttgttgtaaggggtgttcggaactgctgctgagggaccgttgctaggtgtgagttcgatctggacgacactggcactgtcacgatctcgcaatatcgcttcgtgttgggcttgtccttgactggtgagtttgccgacaccgcgctccgacctctcttttttcccgaagtcagtgccgccattcgctgccagtcgtcatccgcacttctcgggcggtccttgtctccgttaaatccatcgccgccgccgtcaaactgcggtatgtgcgaatcggtcgcatgggatgccatctgcgcatcggacgcgggttcttgtagctcaacgtctgatgcgtccatgtcatcccaaagatctgcctcgtccataaagtcctcatccaggaaatcgtccagatcagacataggtggctcctcgacctcgacctcgtcctcgtcttgctcctcaatggcgtccaatccggccaagcccttgaacttttccttctcggtgtccatatcatactgctgaaatgccccggcctataacgtacagcgtatatcaagagcggttattggaatgcaatattttagactgtacatatgtgaacgaaaacctccaagtagcatatggccacgtaccgtttgagaaagcagcgattcgtccacaaagatggaactttcctcctcgttgtatacgaatgaatcatgaccggtctgagagggacccttgccaagctcgtcggcttccgtattgactcgagggcagaagtgatttacgctctcataagctgttacgagggaagctgcaagcggatcctccttgatctcgaagttatcgaaatcaccctgcgtgggcattttctcctgagaccgctgcgatgccatttcccgtacaagatcggctaccatgcgcttgtgcatgtcatcgttaagccaaggtatgctcactgtatcccgtatctgagttgtcggtggctcttgtgagggcaaaccgttggctttcctccgcctggcatcatcctaaaagtatagcaaagacgtaaagttcgggttagctactgacagcgttctggtcaacagaccctatttgctcagttcagtttttacctcccacagaccagccattgagggaacttgtgcagtcaacgaaggaggctgaaagcactcaccaaggttctggtgaatgtttctctccagtgctttgtccctgttgatgattttatccgcggtcgtgtccatctcgatctcacagtgtgacatccggccgggatcactatctggtagccagatccggtcagcaaccgttgccttcgtaagacgtttcgggtgatcgttggcctcgggcatgggaacatcctgtctcaggagagcatcctccagctcaagccagcccattccatagaggttgtagtcgataaagaactgaagcctgaaggggatatgggcttcaaaaggctgaaactttgttgccatgatggcgccacttcgcatcagatccacgattcgactctcgaaatccgggttgaagaggtaaatcttgagaaaagtcgtgtatccgacatggtatccgtagaagggtattcccttgactggtatgattgctgccacatactgcgacttgcgaagatcttgaggcgcgttaagtgcgatcgaggcagcgtgattcaaactggcgcccaactgcaggatgtagctctggactattttgaaatggatggtgagagtatggtcagaacaaggaggtcgtaaacgatcggcattcataaactccatcgtctgtgtacatacgctgagctggctctagagatccatcgtaaggcacgaagaagtggggaaacacctaggagtagtaacaatatgagcaatttggtcagatactacgcgttacaacgtgcgcgatctgacaagaagcttcgttatacaaagcgcaaggcacgacacatacctggtgtatatgtacacagcacttttgtccaacttcgttagcgccaaagactcgtatgacgggcaccttcaggatcgggatatgaggcggtagaaattggcagctgtccatgtccaaaggtccggggggcatcattgcaaagtcgagatctgcaattcgaattttgaatcgcacaggtcgagccgggacggcagctggccgctgctcagtctcctgagcatcggtatgtccgtctccttgagcctggtgctggcccttctcgttgggcaggctggtgtcggcgctccatggcatgtggccgctgccgctggaatccgagaccacagtggatgagttcatggtgcgttgtgggcacttcaaccaaccagggctgtgaatgtaagggaggacaacctctcttgtccagcgtgggcaagctgtacgcgcgcgaatagctgctgtggccgagagggtggaaagacgtcaactgaacgaaagaaacgaaaagaagcgaaccctaaaaaaagaagcgctttgagcttgtgcaaaagttggtggcaacacgggttgaaaaaaaacagaaatatgcacgtcgctttttattcatttcgaacactccgcccctcctatatatccacaaaactcgtgttcctgtccgcctcagcctcgttccatcgttccatcgctccatcgttccatctatgcagctgcatcctcgctccctttcttaagccttggtggtgagctccaaaccaccgaggatgtcctggaacttgttgatgttgcgcaagaaccagtcaccatagcgacggccgaccttggactcggcaatgtggatcatgtcctccttcaggcagaaatcgagatccgatgtgccctggtactctccctccaacagcgtgcccgaaacccacttggtctggcggctgcggatcttggacatcatgagcagagtgcggagctgctcagggtcaatctcgaggaacgacgccaacttggcgttgcccatggtcgtgtacagcttcaggtacgagcgcagcgtgggcaacaggatcgagtggcggacctcggccaagaagatcttggtgtagtgctgcacgggctcgaagggggtcaggttcatgacctcgggatcatccaggttaggtccgttgggcgagatgaacttggggcaggcaaagaggaaaagctcctcaaagacctgaagggcctcctcgggcttggtcagcttgttggactgctcagcatacttctccctcagctggctgtgaatgttctcgtccaggcgggtggggcaaagggtgacgcacatcgtcaagagagcgtacatctgatcgcccttcttgttgatctggtcatgctggtatgagcgggtgtggtactgcttggtgcggttgatgaacgtcaggatgtgcgagaacgccttgatggcatcggcatagcggcgcatcatcatgtaggcgaatccgacatagtagtacgtggtgacatggcaagcagtcacgcgggcaaagagcgcctgcttcttgttcagctcaatgttgtccatcatcttgagcgccaacgtaaagtcgcccaacaagcagtgcacgcgaagcaagccgacgatcgagaagtatccgagcatcttgtacagagggcgcgaaccgtactctccagcagcctcctgcatgtcgcctccgttcttggacaccaacaactgttccgtaatgcgcgacttttggatcaacgagtacaagacgttcaacacactgtagcagctccagatctgagagttgtcgcgaaggaaagcaagctcctcgtcagtcttgttcttgatgcggttgcggtaattgcagaacgactggaactggtagatgaactcgtcaatgatgtcccacaaccactggttagggagctccagagcaacgggtccctcagagtctgtttagataaaaaagaaagggaaaaatgcaattagaacgctgtagatacttcaccatgagaaacgcacacactttccggaaacagaaaacgcaagggcgtcctggatcgatccaagcactgtcctgaatgctccacttactcaggatgtagttgaaaagatcgcagtagttctcatacgagtggaagcggtgctcgatggtgggcgtaaggcgagagtagatgtggcggtagtacagctcgcggtacaaagtcaagaagacctggtctaaaagcaagaaaggtcccagtaagtactttggttcgtgaaacaggaccatgacaaggaaatacaaaatcctaggcaatcgtcgctccatgttcaattaccatcgttgaccaaaggcgagatagcctcgggctcgggccacgactccttggcgtagaacttttcggtcaacttgttgaacgagtgctcgtagatcgagtgcagctcgtacacgttgttctccagaatgttgcggtggaagaacacgataaagttcttcacaacctctgggatctgaacctcctggtattgctgagtggtctggtctgttggtggcggcaacaatatatcaacgcaaaaggacatatacaaagcgttagagaagcggccaacgagattgaagttgacattatgacggccgcacgccctcgtcctgaagtgttgctctgattgagaatatcatgccgttcaagagtcactgctgcgacccccaacttgtcgaaggtgtgttcctgaaaagaagcgaaagcgcaagctgctacgccgctgcactttgaatcgagcaatccaggtcaaaaaagaaaaagacttgcgcgagagtggctggtgtgtactgtggatgaatggtcggcgcaaggtttcaagtgcaagagtggacgctgagttgctgtgcgcgatgggtttggatcctgatctgaagaggcggttggttgagggagaatggaaggtgtgtcgagagtattaccagcagccaagagttcctcatcaaggccatcatcctggacggggtaggcgctaacgaccaagtcgacctcggaggcgatgtcgatgtcctcttcgtagttcatgatgtgaggtgcggtgatgaagaagtgttggatgccagattcgatccagaatgcgaaaaaaaacactggccctcgagggaccccccaagcagcaggcagtgttacgtcactgttttcaaaaaatcgtactttctcaacaatttttatttcgtcgtctgggcgacctgaggagttttctccagcatttgacgttttctaacatgctgggggtccgtaaactcgatactgtaccctacgcagacagcgacctctagatatcccatgtaccatggaagttttgttagaagccgttcgttcacaagtaacagcaatagggctggcgtccttgctcatgcggcttaccttccgggctctttgctatgttacgcctgaggtatattttatcaccctggcgtaactgaagacgatcctgacatgtcagaccatcgttgacataagtcccgcaaagcgtgaggttcttcaggtaagcctgacgatcttcaggtacccattccaacacacagtctatagttaagttcaaaaggtatgagaaaaaatcagttagccagcacggtcgatcggtggatcgcatgtcccaggtatcagatcaaacaacagcaggaacttacgtgtcctactgacaaatggattccggataacaatgtcgcaatctagtagcatttgagggacaatacggcgtcaaaacagtgttgtgtagtccgagagaaaaagcttcctccatcaagttcattcttaccttcattcctcccaaaggtatatttagcctgtgttagttcctgaacttgggtaacctcggtcagaggtttcaaaatcgcccagacctcccctgtgcttggcgacttgcgaagaagtcgcccccgcggttcatactggtatgtgctgtccgcgtaccgacgcctgatccgatcgtcctcggtcgcttctgggacgccatagatgttgaccttgtagacgagtggccttttatatatggctttgggatggcggttgaatagaaaaatcgcagtcaggggccagcatcatagatctctcgtaaagaataataaaagaatctcgtcaagaatgataaaagaatgttgaatgctaagcaaaagcagagacttacttcgtggcaggaacgctgtgttcacgatgtttgggtcatctgggggcatgataaagcccagctcgtctccacataaaagttggcttgccctttggatttcaattttcagactgttgatgtatgtaccgttccgactaggatcgcagaatagtgatgtggagaaggcacaatatcagtcaagctttgaaccgtagtttcgattagatcgtgtacagttcacctgtggcgcccttgccctacctggcattcgtgaccatgatctcgccattagcgcctcggtcaataagacaatgaacaccgctcaacataaagctatttccaatatgaacgtccacatctacagaaacgaggtgtaagccatggtaatgaatgcgcacgctttagacgaccaccgaacgcgcaaacgcagcaccattgcgattatccgccgcattacctttcgactggcgtccaaaccatgtctgatcctttgaaagcaagatacgacgaggagcgtcagggacgcaccctggcagcaatacgagctcaccccacggtgcggctgatgcagggtcttccacactgcccgtttcgcttttaagtcccgcaaaagtcgtgccctttgagttccggttgaagtagtgaccagaaatggtgtgagttagttgtatcaaggtgaaacaacatgaatgatccagtgcagatccttgacataccgaagaagcttcaaacttttccaggtgctcgtccatcatgaggaaccagtcgtcggccagaacgtgttcgattcgaacccgctgggagggatctgtcttcaacatgcgctctaacagtcggagcactgtagtagaggaaggaggtaaagtcgcctatgttagtccatcgaaagttgacccagtgttggttgatggtcaatgtcctcgtcgtttagtggtcccgtaccttctggactcctgggagccttcttgtctagatgcggcctccagttctttttgtaataaggctgccgtcccgcgctgtactcgatatcaagcttgttgagtcccacctccttctcccgatcaattgcttcgcccaactctacgttttcaaccttgatccctaaaggcctgtcatgctcattgtcacactgatcactgtggaatggatagctccccgtcaacctgcaatgagtgtatcgattagaggacaatctcaaacatcacaaatgagccatgtacttgaatgagcgacgggcacctacatcctgaacagtacgactccaagtgcccaaacatctacataaaagtcaatgtgagtgtgtgcagtgagatattaagaatgtcgctgagagctctcagcgcttcagcgagaaggttcgaacatgcatgcaagtgtccataccaacgggcttgccatatccattcgaatcctctccaagggcgatctcgggagccatgtacgagggcgttccacagtgcgtcgacaaaacagggcgagaggcaacacagtgacgcgcgagtcctaaatgttgttgagaagtcgcatgcaaaggtctgatgtcagatgaagcgatagaggccgggagaagcacctcatcgcactacaatgccctgcactctgaaggtctccttgcggccgacacataccaaaatcaatgagcttgacatgcagggtgggtgtgatcatgatgttctagtcgacaaaaaaagaagacaggctcagcgtctacacggttttaggatggtgatgggtctgtccacaaagtcgttttgcctcttttacctcggatttgatatcacggtgcacaatgttgttcttgtgcagatactcgacagccctacagacctgcacgaagatgtgacgcgtgtcgacctctgacatgtagttgttcacatcgcgatagtggccgtaaagagtcacgccctcgataaactcggtgaaaatataggtcttgtacttttcctgcgacacgtcaatgaacttgagaatgtttttctatcatgatgaagagaaaagtgtcaaaaaccgccctttccatcatgatcctgatcctgattctgatctagcagtgatagaacacgcgtagtcattgacttcttgatgccacgtacatgattcagatccttaagcagatcaatctctaacgcgatgccgtcgcgctcttgctggttgaattcccggttgaggcggtcaataaccttgcaggcacagacctccttcgtgcgcacatcaaatgccttgacgacctgagagtaattgccagtgccaagcgtgattttctccagtcgatagatggatttgtcgccctgtatgtcttctgttggagagttatcgatgctccgatacgagtagcgaaacagctccagctcgggctcgcctccagtgatgatgtcgccccaccgaagaagctttcgttcccccttcgccatgggcctgccgttcaaaaaaacaccgccattactagaagtcgcatggagaatggtcagaactgacaaaccctgcgctcgccttaacgttcaataacatacgccaaaagcctacctgatgtcctcaatatacactttggtgtcgcctggtgagcttctgctcggttgctatgatacaaagaggttaaggagattctacctgttagagtcccttttcaccccttggcgttttttttgcactttccccttcaggtcctccatggatcgtcctccctcaacttaccacataaagtttgaaccaaggctcgttggctcgctcaggagggaccgggagccggtgccagtgcgagtggttgatgttcacgtcgcactcggccgaagtcccgaacagataaacgtccttgtccaaggaaaggtcggcgcccatggtcgagccatgtccatgcatgcatgcaaacgtcaccttgccctcgtccagctccaaagcgtcgaaatcagccagctgtgttggctgggttcctccgagctggttgaattgtgaagccgagtactctggtttggcgtagatgaccacgtcctcggccaccaccgccgccgtcctggactctgcggctgagagcgcggtgttcgtgtcggaccaggcaactgaggccgtgtcgctctcatggtcgctggggtcggccccgacggatcccgcggcggacgaggctgcggctgcgccgggctgtcgcgagcgggcggcgcgtgccttcgggaccttgaatggacgcgagtcctgctgctggttcggctgcatggtgaatgcaggaagggcgttggagacgagagaatgagagcggaccagcaagagtgagcagcaaagtgcagcggaattcatgtctgtggctttttggccgctcggttggccacgttcaactttcggtctcagccctggtgccacacacgcgcgttttatttggtgtcgaggactctggtcagagctccgtcagattctcttgtccatcctcattcgtctttcgcggtgagctggtgatggtctgccaaaacctggctgctgccttcgtgaaccccactgccctgtccccttctttaccaggggcccttccacggacactgaacttgttcgcagtaaacacgcccatcggatcgaacctcgccttgttcgccgcgagccgctcatactttgtgagcgcctggtcataatagtacgtgcgcgccgcatgcaagttcctgtcgtgcgagccccaaagcagacgacgatcctgattcgagaacttgcccccctcacccagagcctccagctccgtctccttctggtactgctcagcaaacgctcgcaccttgggcttcttcccgttgtaaaacacatccagcaccaacaggaaactcgaatcccgccagctgaacgacgtcaacccatcgtcgccgttgtgggccaagcgcgagtggcgaccaccaaagtactcgaactggaaggccacatagcactctgcagccttcgtgttggcctcgatccgatcgatccgctccgtcacccactctgtgaactttctggcctgaagctcagtcgacggcagatcagacaccttcacgttcttgatgtacggcaactgaaattcacggacgatcggaaacacccactgattgcacagcgtcgacatgggcatcgcgtcatcctccagcaacgccctcccatggggattcatactcccgggtccaccgagaatcgccatcaacttgttgaaaaacgccggatcgtacacttgaccagcgccctccagattcgcccactgtgcaaagatgatgatcttggcgtcctcaggactgtcggcgtactgcgcgggacgctcgctcagcatggtgatacacatatcgtaatcggctgggaagtcttcagcgtcccccatcgtcagcacaagatccagcagattcttgagcacgtgtcggttgtaagggacctggcctcggaacccgcgcgacaaaggatgatcttcgtccttgtggaccttgagcgtgacgtggctgatgactccaaagttgccagggctgccgccgagcaccgagtaaaacaactctttctcttcttctgactcgctgtggcgatggatccacctgaactcgggctgctctttatctgcagtaacgatacggagcttctggatgtgatctgcaaacagcccgaatcctcgggcgcttgtgccatagccgccggtctgagcgtgtccccccacattcacgtagctgcactgacctgtcggcacaaaccgccggtggtcctttagcgtgctattaagcgagcccaatgaggtaccgacaccaaacgtgaccacagtgtaatcgttgaccgctggatcctcccactccaccgttgtgtacgtcttggacagatccagttgaatgttcttgccagaggtcgaggaggcgccacagtaatgatgcccacctgtacgaactgcaatggcgagcttgtacgtttgtgccagctgaatcgcattgatcacgtcggcgtcgttttgcgcgtacacaatgaaggcaggcttcatgccggcaccgttgtaggacgtggtcgcatattggtacgcgcgactgtcgaatccttcgtcgccgcgttcataaacagctcctttgaatcgagccctcaaaagcgcggttgggatggacttgaacatttgcatgaagaatatggagtgtaaggtatcagtgggtcgaaaaatgtgcaagtgaaaaagatgggtctgtaatggggatttatagcgaacaaggtcattcacccctcctcagcttttttctttgaaaataggacaatagcgtgaattctggagggtaataataaagggggcaccgaggagcttagccatttagcccaagggtcttccctggcaatggtacatgcatacgatacatgcatgcgaatatgtcataggccaaggaaaaggggtggatgtatcacttttttgtatacgttctggtagaatagtaggtcagcgtcttacaaagacgattgtgctgcatttttttttacagctctgtcgtggcctcgtcgcgcctcttttcgggtgcatcaataatggcctgccaaagcctagtagctgccctcttgagccccgcgaccgccatcgccccttcctttccagcaggcgcctgcacgctgaactggttgggcgtgaacagaccaagtggatcaaatctcgccttgttcgccgccaatcgctcatactttgtcggcgcttgatcaaagtagtacccgcgagctgcatgcaagttcctgtcctgcgagccccaaagcaaacggcggtcccgattcgagagcttccccacgccctcgccaatagcctccagctctgtctctcgctggtactgttgagcaaactccttgaccttgggcttgtctccgttgtaaaacacatccaacacaaagatgaagcttgaatcccgccagctgaacgacgtcaacccatcatcgccattgtgcgcaaaccgcgagtgccgacccccaccatacgcgaattggtgtaccagatagcactcggtcgcctgcgtgtgggcttcgattcgatcgatccgctctgtcacccactctgtgtacttgcgggctcgaagctctgaggacagcaggtcagacgccttgacgttcttgatgtatggcagctgaaactcacgtacgatcgggatgatccagtgattgttcagctctgacatgaccatcgcttcatcctgaagcaacaccctctcgtgcggactcatgctgctattgttattgctgttgttgttgttgttgttgttgtcgtcatcgtcgttgttgccacaggcgatatcaatgagccttttgaagaacgtcggatcatacacttgaccggccccctccagattcgcccactgtccccaaacaatgatcttggcatcctccgggttatctgcatactgtgcagagcgctcgctcgtcatcgtgatgaccacatcataatccgccgggaactcctcatcgtcccccatctccagcaccggatccagcaactgcttgagtttttcttgactgtaaggaatccgacctcgcacaccgcgcgataaactgtggtcctcatccttgtggacctgcagcgtcacatgcgtgataactccaaagttgccaggactcccacccaccaccgaataaacaactccttttcctcttccgactcgctgtggcgatggatccacctaaactcgggctcgtctgtctcggccgtgacaagacgcagcttctggatatggtccgactgcaatccaaaggatcgagcgctggcgccataaccacccgtcgggcaatgaccccccagatttacataactgcactgacccgtcggcacaaaccgtccgtgttccttgagcttgctgttcagcacccccagcgacgtactcaccccaaatgtcaccaccgtgtaatcattcgtctctggatcctcccactccacagtcgggtacgtcttggacagatccagctgaatgttctggcccgaggtcgaggacgcgccacagtactgatgacctcctgtccggacagcgatcgcgatacggtgctccctcgccagcttcacggcgctgatcacgtcgttatcgttttgcgcgtagatgatgtaggctgggtccatggtgccggtgtccttgaaggacgaggtcgcatactgatacgcgcgacagtcgaacccttcactgcctcgctcgtagacagcgcctttgaagagcaccatcatcagtgcaatcgtgatagcgttggcgttgaacatgctctgaacgccagtggggagagaggactagagggcgagttgaatggatgtacgtgaatgttttggagagaccaacgcgttcaggtggggatggggcggctttataacccgaacggatactcaactcccttgtgggtcaatggattacaacgttccatcggtcgtggattctgaggggggcgagaacgggtggctccaccctaagggagggatgcgagtacgcttatgctatgttatgcgcttgcacgagcattgaccaaggcaaaaaagggggcagcagagggtccattccagcctctgcctctttgcatacggtataatgtgggttcctcccctaatgctgacgcgatggacgagatatcgagatatctttttgtttgctcaaacggccgcgcaagagattgcgctgcaaatgtgaccctcctatgttacacttttttgcttctgaagtcaatgcgcctcaaatccttttgtgaacatctttgacgtgttttttttgcatatgctgttaactggggagaggaaggcaatatctttgatctcttaatgcctcagcactgtctgcgattagcaatcttctccagctcgctcaccatctcgttcaagcgctgaatctccttattcgcatcctcaatcaagcagtcctcctcctcgctcgacaacgccatcaacgccaactctgcatccacctcaaatgcaccgtcgcgtgcagccagcacatgtccacactctccctgataagagcccgacagcacgctgctagcagaggtgcggcacgacgagagagaagacccagccgaggactcattcgccaactcgcatcgaatcctctgatccagctccaaaaggctttcgcgcaacaccgaacgcaagtctgagccgtcatggggcatcgcatgggcatggacccgccacgaacgccgagccctcttgtcctggttctgctcgtgctggatcatccgcgataggtgcgtatccacccgagtgagtccgttcgacgacgagctgttggaatccgtcgacacagtacgctgtcgtacccgaagactgaccggcttgggcgacccgcagatcagcaacgagttctcatccgtcagttgctcgacgcgcgctgccagctcttgagtgttcacatccagttccttcaattccagctcaacagtggactgcagctgacaaagaccctcctgcagtgtcgcggtgtcgttcaggatactgggcatgagctctcctgcgtcttcttgctcctgttctgcctgcttccgggcttggatcgcggcataaaagtcatccgcccacgctcttgccgaccccaactgtactttcaattccgccagctcctcatccttctgcacaatgtgatcgttgagctcctttgcataactctccatcgactcgagtttggcgtggtgctgctgttgaatctgctggagatcaggcatggattcctcgacgaggagggtcgaagggcccgtcaagaggatgctctcgaccttgagtcggttgtgctccttcttccacttcagcttctcttccttctcctgccctcgtgcagcctcgagctgcaggacggacctcgacagctcccgattctcgccatcgagccgcctgagcccagcgttgaggagggcgccttcgtgttggtacaatagccgctggatcgccaagagtcgccacatggcctgctgagtcctctgcacgatttgatccattttgcgcgtcgtagtgttcagctgactggtggcggccttgaccgcgctcatgttggccgtgctttcatgcaaacggatcagggagtgtgaagcgtcccgtatccggctctcaacgtgaagagcgacattcatagcctcgacaaactgctgcaagtcttcttgttcctgaaaataacaccatccaaaaaaaaagggaggaaaggagacagggagggaacggaacgggtgagcatgataaaaaaatctaggctttttcgaccataaaaaaaaaatagacagtgcacagcagagccctgcagtaggcgcgctcattcttttttttttttttacctttcttagcgtgtccagttggtccgggctcagcactttataaacacgactcgcaatcacagacgcgctcacggccttttggacatccttgggatccatgctcttcagtaaatcctgaggaatgatgccacagttttccttctttctcagcatctcactcgcgatgggtaggacggggactggaagtggatcggggtcgttgctttcaaaccgacagcgacttctcaatgtctgctgaaaggcaacgggtggtggtcccggaggcgtcgggggcagatctttggtccgtggtgaggagccctccgtctctgggtattcggagagggactcgtccgagagcaccaagtgtcgggttagaaaccgccctcgaagctgctggtgatcctgaccattgcttgatttctgccgtcggggtgcgcgcgaaggtgatcgctgaggggttggggggcgaacatcttcaggcgtgggagatgtcatctcggagggggaggatggactggacgtcagtgttggctcctgcgaggacgagccggtgttgaaatgatggggctgcacacgctgccgactgcgattgcggttcggtgcctggcccggaaggagcagatggccgggcgaggtggctctgacggttgtaggctcatgcgcgtccttgacaaatgcattcttcatatcagggagcgacacattgcgcctcaggtctcctggtttgagcagatcggccggtggaggctccaggtagtccatggcttggttggagggcgaatgaagcagccgattgttgcactcccagtcctcggccaccgtgtcgtccgagtgtggtcgattccgttgctgcttctggtgctgctgttgttgatagagatagacctttgggttttgttcatacacacccgaggactcggccagctcggccttgcgcgcagccgccaggtggctctcggatgcctttcggttcagtttgacagttcggaatgcattgtcggacgcctgccgagccatcttgaacaggttggtcccagacatctttcgccgtgggagagcgtggtcgagcgagtctggtttcaggtggtgatggtgtgcttggtcaagctcgagataggctctggaggatgatttgatctcgctcagagactctgggtcgggctggaggagatagtggtgctgctgaggttgattgtggctccgagggtggggttctacaggctgtccctgtgggtttgaagtgaaggtgtacagactgttgttagaacgcatgatcaggaggggctgtgtactattgttctgcgtttgacagagaacgaggaaagagggacaggtgccttacagacacggatcgttggcggctaatggtgttcatgtaagggggaggggacaaggagcggacaaacttgtccgatagggatctctttcgcatgacggtgtgtgagggcatggtgtggtgaagggaatgggtcgttactgtcggtctctgccagtgtttgcaaacaaggtgcggatgggaaaagggagcgtgtacgcgggaaaggagagatggttggctggtctgagaagggcaaggttaaggacaagaggcagtccagagggaggcaaaatagcagagcgtgcccctgtgtcgaacgttggcgaaaaaaagggtggtcgtgtgtcgaagggagtggatgattaggagaagggtcgttaggaagggccaggaaagcagcgcgtgggtcgagaggcataggcgggatgggaccgtgctgtgtttgcgaaaggcaagcgctcgtgaggctgttgttacagagaagtgaagaaagacaagaaaaaacggaggcaagcagcgacagcaggcgttgcgtcgtggggatggcgagagcacaaagagagcaaaggaagcaaaaggaaggaatgaaaaaatgcgagtagcaaagcaaaagcaaacgggagtgaagaaagacaaggacaaagacagagagagaggagaaaaagtgcgagattgatttcgtaagacaactgtattaactttgtttgtgcgaccctggcgctgattggacagaccagacaaccatgcacacacaggggcacaatgggggagatcaaacaaaacaaacattgacccttttttcttctcgcttgcatcccccttcatctctcattctcacccgcgcacctctctccagggcccatatggctgctactgtgacgagctctaacggagcatcgaccgtggccagtgggccatgagggatgcaaagttgggtcaaggaagaaagacatccttgccagccacgaaggcagccgtcaagggacagcactttagtgcaggtacctcttgttgcttcgcactttgcaaaccagacatggcttgaaaggctatagtaaatgaggatcggactcatcggagacgaatcatacattgacagacagacagacagagagacagacagtcgcattaaatggtctgcttttgaagcaccaatctccgacaagacaaggtttgtctgcaatatcctcacatgcgcggagtacacaggaccagacttgtttcagggtctcctcgagcactcatttttcgcaggtctctgtggtacagtgcctttctttccttcgtttgcacctccgagcatcccccacaccctcgtcctccatcatcgactcaccactttgcgccacctcatctcgtaaagtgatatcaatagcactgttcacactcctcctcccatcactcacccgtttcatatcgcggcacagaaggacacaaccgatgaagcagtccgacactcaacagtacatcgatgtacacgacccctagactgacagaggggagggggtatccatcggcccgctagtgaaaacttagcacaagacatcatgacctttttgtttgcctcagtttaaacttcaaatcaccttctatttgactgaaagaacgtctttgaagtttctagtgtgccccacgattcccgacaccatgtttacaggcgaaacgtcaattcgggcccttgctggacctcttccatcgcttctttttcaatcccagagctggcaggcgacgttgctgacgagagagcatgcatagaggatgaaggcgacgaggtcgaggacgacagcgttgtgctgctatcgtggcgcatcggcttcttggcgtcaggtagaaagtggtccataaagacaggcgaggcagggatgttggtggctaggtgcatcaagttggctgcctgctgctgccagttcacactggccaccatatctggaatcctatgccgccgctcttccgtggtgtaggcagtaggtgtgagttccagcaggacgccttctgggatttctagacttggaatctcctacaattggtttcaaaaacaaaagtccattttgcgtcagtaagagtgctgtgccgccaaaacgcagcggatgaccatgagcggtggcaaggcaacattaccgattctggaagaccattcaaatagccgtagagacaccgaaggacactctcatgtgccacaatgaggacatcgttcttctcccgttctagctccaagatgaccttctcgaggcgattcgcaagatcatagtacgactatggcagacgatggatgaaaaacatcgcattgatcagtctcacgacgcagaaacgagacacgggtagtagcacatttaacacaaacaatgtatgaacctctgcgcgcgggaagcgatggcggtaggggtctgtcttggcccttaagcattcgtctggatacttttcttgaatctcctgggccgtcatgaggtcgcacacacccggatttctctctgccaagacgctcctttgcctcacaatgatttcctcgtggtccaagaagtgtgctgcagtctgaaagcttctcttccgggaggatgtccacaccgtgagctgccgcggtgcatcctgagcagatgacgaaacgggtgaagactgtgcactgctctcgcgaagtgtcaaaagaaagtttttaaggttttccgcatatcgatgtcctgcaggtgccaaaggtgcatcggcgcgataagaattctcgttaagagaaacgccgttctgggaaaaaaaaaggaaatcaagaagaaaaaatcgtaagtctgttgaccagcatctagcctggtcggttattatttccagcacaatccgcttactcttgcaaaatatatcgttcttggagagatgtggaggttcgtcagataatagacaattttgctctgcaagaatccctgggcgttattgaccatgatcttttcgccagcattgatgactttgacaaagctgaggctgagatccgagatggtcgtgtaaaatggcacatggttgtctatcctgcgcttgaaatcttcgacagcgtccgtgcggtcccatccaacgtactacgtgacagatgaggcatgttagtcatgcctgcgctttgcttacacaatccagataaggacatcctggcgagcatgttcttacatcaggtgaggagaccttgacactgcgaatgttggcatcgatgatggctggattgtcgcagatggtctcgataaacatgggatggacgttgcaggccttgaagcgctgaactagctgttgccgccgctcctcagtagtgttgcttccatcgagaatgccgacctggccgcctgctgtgaaccactggaccatgtcgtccaaacatgcgtctgcgatctgtgcccgcagagccgcggtggctttgttggctggaggaggaagcacccacaaccaatatcggacacggacgcacgcacgagttggcaagacagggacaggggcagcgacgacggtgcataattgtcaagggatgagggtaaaaaaacgaggggtgagcgcgatcgatgcacatgccagataccatcgaaataagggcgcagatccatgcgttgtagatttttttgtttgtgagccaagcgtttcgacgagataagataagacgcaccaagagtcgagcaagtgccatgaagagaacacaaaagaaacagatagcgatccttggttagtgaactgctgcaagtatgacggatggaaggataaacagcctttgcgccttgggcgatcctgcgagccttccgtgtgcagaagagcaccacagtgcgcttacctgggctgaaaaagtcgttcgttacttcgatgcccacgagctgcctgcgatagttgcccacactgaagacgcgcgtctggagtcccagccagcgcaggtagcggtagagcgatctggatatagcagtttttcctcgtgcaggtagactgggcgaggataacaagcgaagcgaagggtgaataacactaaacgaaaaagcatgtcggcgttgagctgagcatggggtgcatggcacagggaggcctacccgacgaggatgatggcgacggcacccgcatggaagaggcggcctgattcggtcttgtagagctgaccagggaacatggcgtggctgtggtgcagtgatgcagtggtgcagtggttcttttgtgaatggctgttggaagcaagcagcagagcgagatcagatccgagaggaggactgaatgacgcgtatgaggagagtgagaatgagagagacgaaggacaaaagaggtaataggcgcagcggagaagagacgagactcagggtggacacgcgtggatagggatgggcagcaagagacagtaggaaatggagggaatggaatgacagggtgaacaaaggcaaagagaacaaaaagaaaaaaaaaagttgaattcagttatcatcgaagaaaatctcttttttagggcctctttttgacttcttattagaatagcccgaatgacgcgcctgagtcagtgtggcatgcacaggctggccgccctcgacgtgttcggtggcccagcagcaccatggttgcacaacgacggcctatactgcctatctgtcacctctacagaccattttctgatgccgatgctcgtcctagtcgacaccctggcgatcggatgctgatccatgcctctggataccctaggggctgcatcgcccgatcggacagtcaggctcacgcagctgtgcaggtgtatcgaaatagcagtcgcagtgatggcatcaaagggtgtgctgtaggagtccagtccgtctttggtgtccccaagggtcatcagcgttgtctcgctgtctctcgttccctctctcgctctcttctctcactcttgctgtctctctcgcacagagtgtgttcccctccgcacgttcaagtgatgaggcagcctggcccctttctgatgtgcgcgcgcccccttttttttgtgagtgtgtgtgtgttgcgttatgtgtgtgttctggtactggcgggtatgtgttgggtcagtggtgtgtgatgggcagcatgcctttttgattgctcgctggcgttgtttgctgctgtctgtggatgcgcgctctcgtctgtgttgcttctctctctctcttgtccccattccttgtgtatatcgtgtcgcccgcaaggcatcattgctcgcctttttttttcgttctttttgttctctttagtctctttggtttaacaatcacctccgtccccactcattctgtgtctctgtctctgtctctgtgtgccgctgtgttcgccccctcgtccttttttctggtctgcaacggagaccccgttccagctcgcccattcctcttcgcggcactcgatcgtctctcttgctcccattcctcgctcgcgctcttcttcttgtcttcttgtggattgtcgttgtccttgctcactctcacgctcactctctcactcttgcctctcactcactctctctcactctctctcactctctctcactcctgcacccgtggtgaacgaaccagtctggacccgttttttttatttccctctcgttctcgttctcgttctgcctcccacgcgtctgcattgtctgactctctgcctgcaatcaaaccctactgcaattcctctcgtctgcaccttcagtctgcatcccgtcccattctcctccatctctcgccaacagtgctttgctcgcttgtttcgcttgttctgcgtgttcgcctgctcgtgaacgacagcgacaactatcggcatacaaaaggtatgcacacctcattccttcactcaccctagacactgcgtgtggagggatgccttaccttgagccagcaacgctactgacacccaccaacggctgtctctgccacctttcttgatccctgtcagcacactatgagcaaccatgccaaaaaggaagcctcggccaaaaactctgcctcgttagccaacctacgcgcctctgcagcagaccagtctgaggcaacaccccgcaaaactgtttctcatgaaggatttcaaaaagcaccgctggccagcaacgccagctctagcagcggcttcagttccagcagcggtagtgccgcaaccagcaaccacactcgcactgccacaccggcctctgcagagggccatggtgctggtgggagcgtgtccgcattctcatatctcaaggccaagctgttcggatccgtggccgatgcctccacctccatcacatcctcagcaagagacctgctccagcccaaaaagaacgcagagacagccaaaggcgtacaggactcatcagcaagggccggtgcaggacgtgcgccaggagagccggcatcaccactgccttccacagattcgagcggcgcactggcctcgcgcacggtcacagacgccacagaccccaattatggggccatgatgacacatgccggagcccaatcgcaccagcaccacaaccagcagcagcagccataccctccacctcgcttcttctcgcgcactcttccgagccggcgacagcctcaaccagagccattgcagtttgctcagggaaagcctaccaaggcgggctcttcgacagacccggggctgctctcagcatcagatggtcggtcgccatcctcgagcaactcccacagcacactacttctcccctctcctcgatcggcatttaatcaaacaacagatcagagccaaggcctgcgcatgagccagcgtcgcatctccacaatttcgttgacgagctcacaaaagcacctaagcacaggcagcatcatctaccaagagggtttccttaacaaaaaggtggaattgcattctggcgagactggccatggttggaaggtgtacaaggtgctcttgaagagctccaagctctacttttataaacccttggctgcagaggaccggccgcggttccaggatcccaaggaccaccagcggcggaaccagctccagctctcgccagacagctcgctccgcaatgtcacacatctgcttcaacattcctcatcctgcggtatggcgtccccgaggctctccatcaccagcgagtgtggcatggtgctctcggcctccaaattcgagtcgtcgaccaggacattgctgtttgagggtaacgcaaagtccctcaaccagggcgcgcaagccatggctccaccggtgtcaaagtatatatatggcgaatgttttaccgagattgatcgctcgaccatgcagttcaaaaagcacgtcgcactactgctcttcgaggacagcgtcatcatctgcaagcgcaaatggatccggtacacctcaaccaaggtcaaggacgccatcaagttcagcagctccaacacccatgaaaagagcgacagccaggatcttgtgccgggcaggcgacaaccctccttctcgggcgttagccacaagtctagcgattcccgtgggagcgaaggcgacaccagaccgcggagcagcttcgaccgtccctcagagaagcagcggggatactttacgaaatggaagcacgaggctacctaccccttgtcgcaagtagaggcactcgacatggcttctccagtgccgactgcatcaacgacattctacccatttgcagctcccgcctctgccgccatgggatccccatccgcaataggaagaaacccaagagactcggatgcatcctcaatctacgcagccgcaagcatgccaacgtacaatcatcagacaacctcaactttggagctggtcataacctccagcattgatggcaaagaatacacacatcgcctgttattcttacctccttcgcaggaagttcggcaccaatggtattcgaaatttaatcgggtcaaggaactttatcaagcgcagtcgaggacgacatccaatggtcgaggtaggagctgatctttttagagtggctacatacgaaatggctgcaggggagggaatgtacatgactgacgatcttttctctgttatatgcgatcgcagtttcagcagaaagtctagccttgaatccaggctcaaaggatgcactttattcaccaacatcccccagagggttctctgatccaaacaagtttgttctcaacactcagaaaatgaaccgggtgcgtgcattctgcgagacaacagctcatgctgagctcactctcgtcttggacgacgcaactggcaaagagaaattgacgggtgcttccatcaatggtctggtacacgagcttgtccataacaaccttgcaggatcccactcaggacttgtctatattttcgctgcgacctatcagctcttcaccacgacactgcacgtcctaaaggagctcaaacgctgcgtcaaccttcgttctggatcgatgaccaaagacgctacggatgaaatgagtagacgagttgagaccctactgcgagaaatggtaaagggattcaactgcaagatcgaggacaaggctatactggaagagattcgagcaactacgaagcttgtcttacaggaaggactgaaatgggcagctgcagaccggattgtgaaggatattgatgcgaaactccaggaccaggttcactcaccaccagtgccgattcgcgaaagttctgctcaggcagtaccgtctatagagtcaacagtggatctttcaaacgtcctcatcacaggattgactccagccctttttctaagactcgagccttctcagtttgcggaacaggtactgcgttaccactcggatcaattgaccaggatcggtggattctcggccttgctgaataatccagtattcctcctgcgccaataccccacagcagccaacatgcagcacctgcagagccccctagtattctcgatgtactcgcctcatttcctgacagttctcatcacccatcacattctcatcgccacacaatcagtccagagcacatccaggcgaccaggtctcctcacacagtggatccggacagcaaaatgcagcagggctattggggatatggccggcttcattgcgatcgccattggaatctgctcgccgggagtcgtgcgcctgcagcagtcgtggaagcatgtaccactcgaacttcgtttggaggtagcacaggtctgggtgcctttgttgatcaagttggacatggtcacggacgatctacaggaactagcgatctctagctttgatctcaaggcatccctcaacaccatcatcgacgcgtctctcgagggcatgaatgtgtctgtgccatgtatcagcaacatcaaacagtcggtggatcaactcgacagagctatgccgtcctttattcaatcgacaccggtaccgctgctcagcgttgacaagctggagcacattcacgccatcctctgcagggccagaaagtctcttccagcacagatgccaccagcacggatcgcgctctcctccgtggcgaatgggcacttgcagcagtattttggacatttggcctccatcagccagacgctgcacgatcaatatcacgcgagcgagctgtcgaacgatgcattcgaatcatcgctggcatgtgaaccccacttcaacggacagtatctggactaccattacaagaaccgcaagatgaccggcagctttattccgttgatgttccccgaagttggcccgcaataccgcctgttccccctgcagttactcttgaccctggagaatactggaaacaccaatcggaagagctccttcgacgacatgcatcctttcgaatccattgccaccaaagagacgcacgtcaagcaaccgcccggatctgccacgctgacagcaggatcaacaggaggagcaaagcctatagagtacacggattctctggcgacccatcatggagggacgcatctgacctcgacgaatagctcgccgtacccaaaatcacgcaagcgcacctattcattcccaccttcccgaatttccccccgcggttctcattccgggggtggtgtgggagttcaacatatgatcaacatgatcaatccacacctcgatacggtcgcgcgggagagcctccatcactatgaggaatctgagcaaaacgaggtgctgcaggccatgcgaagtgttgccggcgtaggctatagtatcatctcgttggaaggcggcaaccttatcctgaaggccaaagacgagagtttggagacactggtcaaggctgtcatcttggaagaggaagaggcgcaacagctccagctgcagcagcagcagcaagcaccgtccgaatcccaaaagcccgttgctgtcagccagagttcgaacaggaacagtcttctcgtcctgaacggcgcccggcctgtggtggtgaaggcaggaacgctggagatgcttattcacgtccttgtgatgggactggaaggccagagtggaaagtacatggacgagaagggggatcttatcccgtggaccagccggcagcttgttctcgaccaagaggcattcatggattcgttttttgcaacctaccggagcttttgcacttctgcgcgcctgctggaccagttggtcatcatgtttacctttgcagacgaatctcggacaagagaatctcatatccctacgggtctcgacatattctctgggtcccttcagacagcactttcgggccctggcatcactggtgctggactcggcgaccactctttattcaactggaaaaagattttggccatgcaggtcctcgttctcaaggccttggagcattggttgacggcctactattttgatttcatggacgacttggtgctcaaggcgaaactggccttcgctctcaagtctatgtgcgctcaagccgagtctcaaaaactgctcatggacgaggctctccggatagaggcccggacccttgacgagagactaaagtcgatcaagaggcttgctgttcaacaatccatgcgacccattgatgcgacccacttgcgttctcacaccttggagacgttttttggcacaccgcccgtgaaggagcctccactggaagacgcttggagcgcggatcaaatcttggagcagctcaactcggctgtgctggcccactttctctcggttcgtacgcatgagtggtttatgctctttgaggtcctagagtcacagtctgcagatccattggggtggtacctgccgagatcaagcacatcagcggtgggagaagaggatgtcgtcatcacagggatccacagcaccctctacgcgatccgaaagcaaggagccctgggaaccaactggagcggccagcaactgatcagttcattacctatctgtctccagagcttgtgcaggctccatcacgtcattcgaggctgggtcgtttctcaagtagccgcacccaacattacctttgaggttcgactttgccgagtgcagaaaatgctcaatgtcattctgcggagtcggtcagccatggatcagtttggggccggccccaagtcgcctcgtttgaacaatcctgagcgccccaatctcggaggtgtgccatccttcgtcgagacggctgtggtgagtgccttggtcagccttgagagccgagcatactcgcgcttgtggctcgaggtcgtcaaggggcgcaggggagcactggagacattagaggatgtgctgagggtccaccaggagcacgagcccgtcattccgtccaccagcaagcccgtatcaggagaccttatcccagcgctgggttggctcatagagcgcatgctggagacctgctgctatgttcgggacatgagctatgaatccccattgctgatcaatttcgacaagcgccattacctctatgatcttgtcaatgtctttacgcggcgtcaggaacagctcaaccacctcaccgacagtgtcacggtctcgcctttggtcgcctggctaggtctgtccacgggacccggctcgagtttgcaaatgaaggcggtgcgcgaggcagctcagcgtgagattactgctcaacggaacacgtccactggacagctgtccgcatcctcggctggaagttcaggacgctcgccctccccgcgacccgtcaaggtgtttgcgcgtcttgtggcgatgcagcaggagaagatcaagcgggaccaaaaggagtatgagaaactcgatcgacagatcaaggatacgcagggccggatccaacgagcccagcaggagcaagccaagacgttggagaaacaaatcaaactggagcagagtcgtagtcgtgtcaagaaccagctgttgaagtcgacgctgatgcgagcgatgcggcccatctctctggcaatcaccaactcttggagcagtgctaccacgaccgtgagcaacgccacggcgctcgggagcgccatcagtggcaaggtcatgggtgggaatgtggccgggcatgacctgagccctgtggactttggtctgtcacagcaatatcatcatcttcagcagcagcaaggcatgatggattcgcagccagtgcagtcttatcaaccacaagcgcaaacctcgcggatgtcgatggcaggaagtgtccactctgccacgacgacgttgaccggtacgacgcagaagccagccctggttattaatttgatcaactcgacgtgctcggtggcctatacgtatacgaaacgggactttgtcttcaagatcgtgacggaagaaggcggccaatcgctcctgcaggctctggactatgaggacatgctcaagtggatcaaggtgatgaacgaggcggccgcggaagcgactgcgaagaggcgcacactgctggataatgacgagtcgctcaagcatgcgctcgagaccgcggcccaggtggatgagatgccgttagtggtggagaatgaacgcaagggtcgcaactcgggtaagttctttgactgcggatgggggacttttttttacgctgcacagtatagtatgaatggttcactgacgttctttttatatctgcggttttacaatagtctttggcgtcgagctgcgtcacttgatgagcgacggcaacattcccttgatcgtcgaaaagtgtattgccgagattgagaagcgtgggctggaagaagttggtatctaccgtgtgccaggtgccatgtcctcgatcaacaaactgcgcctctgcttcaactctggtaagcgctgcttgatatcaacctctcttttgtttctgaactattcgtgattaactgtatatctgctgattcgacatctgtaggttctcatgaggtcgacttagacagcgacgagtggaaggacatcaatgtcgttgcaggagcacttaagcagttcctgcgcgagctgccagaagctgtcatgaccaatgcactctacgacgcgctaattgctgcatcaggtatgcacctcgtttttcttttcttccgctcacggtcatacgtttgcgacctcattctcacccattccttatacttgatgccttagcacttgaggactacgacgagcgcctgatgacaatgaaggatttgatccgcacattgcccccgcataattatctactcctgaagcgggtcattgaacatctcgagcgcgtcacggactatgaagagatcaatcatatgtatgccaccaacctcgccattgtctttggtccgaccttgctccgtcccggtgggtcctctgccaactcgtttgccacgtcgatgaagaacctgggccatcaacagaatattgtccgcaacatgatcctgcagtaccactggttgtttgatgtcgaggacgaggaacaaggcgatgcgatcgaagatgaaaccgtcgcctccggagtagcagctgaggttgaggccgagaccgaggacggcgatgtgtatgaggacgaggaagggctgggcgagttccctgagattctggaggacagtgatgaggatgagtatgaggaagagcgtacgttggaagacgacaagatcatgatgctcaccgctgcaccgctcgtgacgggcgcagcgtccacgtcgtcgtcgacggcgacgggtgtggtggcggatcggaaggatgcggattcggagcaagggcagaaggctgcgaaggctcagcgtagaaagactattgtgtttggatagagcaagatggagggtgaggttttttttcatagagtattttctttgtgatgttccattaaaagagtcgtcaaaagcagaagtggtctctcactgtacttttcttgtcaccatcaatgacacatcgaaacatggtggcaacgcgtcctgttttgacagtgccgcacgaaataagatgtcgtcagttatattttaacaaagttacacaggttcacttcagattcggtaaagagtactagaggggcgcgctcccttcggtcgcgcaagagttttcgtccttccaaacatgtcacaattggtaaggcctttaagattgagaagttagtggacttagttggttgagtagctgcaacatccttcaatacatttgtgaattccaagttgcgagtgtatgcagcatttgtgaggacaagatgaggaatcatgaggcacttgaagttatccaagtagttgcaccgagaaagagccaggtagagacaaccgtgactaaagacattatcaggaagaaagactcatagccttaccaaaagtcgtgtgtaggcgtgtacacgactaattctgtatactcattcaaaacactagagttcctgagattaagcgtttcgttgcgtagatttgttcgtgagaagacatctttcttttcgcgcaggctagagtgcaaggggatttgaagagttaattgagatacagaaaataataggtaatggatgataaagaatgaggtcgtgtttattgcgcgacgctgataatgggtccatgatttacgttctgctcgtcgtacagtatccgttaagaatcattatggtcattgtttgcacgttcagctggttgcttaaaaaactgtactcgggtagccttagtgacgttccgtaaacactatttgtctgtcagccaagtatcctgtcacagggtgagtgcaatatcctactctcgcacaggcatgatacgcattatcactggaaaccgagcatgggccatgggcacctccgcgtgcaaaacaagtataaaggtgagagtaggcgcaggaggcgcacgtatgttgcttcgcatacacctcgcattgacttttgagcgtagccacctgggtggtcaaatttccgttctgtgcggtgagatccaccaccttggtgttgcaagtcgcccagtctgtgttgcagttcgccaaggttcctgtcaaaccatcgttttccttggtgagacgcaacacgttcgtagtacaggttgtcaagttcgagtcgcaggtccccaggtttgtgtcgcaggtccccaagtttgtgtcgcaggtatccaagttagcattgcaggtccctaagtttgttttgctggcctcccagtttttgtagcaagtcgctaagtctgttttgcaggctgcctgtttttatagcaaccctccaagtttgacttgcaggccgccaagtttgctttgcaagagcctagtggtgccaagaatgagacagacatgacttaaatggctacaggctaaagattgaagtaattcggaggatcgatagacaagaatgagatcagaatactcggcaggcagcacaagtggtggtcgaacatagaaacaattgaatgatacgtacctggtgaggggagttatggaaggaactggaatggaggaatcgatgcctctcgatagcgtggaacaaacgatctctacttgcgatggaaggtcaaagtgggaactgtctaaaagcatactgtgcgaggtcaagatcaagaaaaagatagccaaatatacaggacgagaagagaggaacgggagtgagggaagcttaccgtatttgtgattggcgagtgctgaggacgaagaacgatatggatgaaaaatgaggagattagatcccttttatgcgcactttctttttttttccttcactgcccacagcttggcacgttcccatgcgccttttctttttgcagacaaccggggtttcgctctcacgccatggcacgttcccatgcgccttttcttttcttctttttttgtttcgttacgcacgctcaggcacggtcccgtacccctttctttttgctctttcttttgacatccatgtcctggcacgttcccatactccagtctctccttaccctctgtcagtgcttgttttcttttccgtttttttgctacccacgctcccatgcccctttctttccctgtgccctctatctgtgcatgtcttcttttttctttctttgctatccacaccatggcacgttcccatgcccttttttgttcatgcgctgtgcatgtcttcttttttctttctttgctatccacaccatggcacgttcccatgccctttgctgttcatgcgctgtgcatgcttttctcttttttttcttggttgttttcctttgctacccttgcccccgtgtcaacttgacagttgtcgctctgccgccatctgtttgagtagacatgcgagggagcaggaataaactgccccaatcaaactctgctcgatcctcggacaaccattcgagtatcatgcaaagacctcctttggcatccagtgctccgtaggagattgaaaggtttgccaccttcagagtcagtcggagaggcggtgggtcgacggatcccagtcgttcagaaactctgatgggtagttgccaccgtactctgtatctgacacgctgtcttgtccttgatgattttggcctttccagggagcatggaagtagccggtgcattgatcttattcaactcgagggggttagtaatgacgttttgcgagtgcgcaccgtgtctgtgagaaatgaggagtgagtggttttttcgccaccgatatctcgaggttcgggctttttttctacgtcagaaagcaactcgaggcatttgcctagactcgtgaaatttgacatgcatgaagattttagcaactttgatctcgctgaagctgaagtcaattatactggcctggtcgtctgaacgttaggtgcgtgtcgtgggtcgaaatggtcgcaaaatagggcgaggacgatattcgttgctcagtgtttatgaacttcagttggctaactaagagtgctttgacaatgtttttattatcgagatgtttgacagacaatccacggagatcatgtctgatgtacttcaacctttcgagactttgagtactttggggcaaagttgtcgcttgctcgccatcgacgaacacgtccactttgacattatcgtattgatcaaacctttggtttaccgctcctgctactccaagaaggtgggatgcggattgcacatgaagtgaggtgccttcactacgttgccttcttgatgtagatcagctctgatctccccccccctttttttttgttactaacaattgatcgttgatggaaagtattctaaagtgtcaacacagtatattttgaagtcaagcagtgaagaaaatgcagcatattgtcatgaagttagatcgatgaggaggctgggttcaaagcttctgcctcctcattgcaaacattgtggcaacgatgcacggaccaagcaacaacattttggccactataaatattaggtctcacacacaagaggacttgtggctctagcacatctttcacccaagcacgccacgacaagcattgtcgtcttagaattcagtattcgctctttagtgaaaacaatgaaaaaagtctttgcatcttgcactatgtagatatccccatttcatactgaacagcttcaaaggctgacatgatacgtgctattttgtccgcctcccatcggttctgtgcgcatcaaaccttgctctgtgtaatagcaaagtcggttgttttgtatttgtagagacaagacatgccgactttgggaaatacccctgaagcgttccgcattgaccacgatcactgcgggatgtatttactgtacatgtatgtcacagcgaggggcttctttgttttttgtcccttcgcgactgaagcacataaacgtgcagaggttttcccgtgcagatcaatcttcaggctactctgttcagtagactataaggcacttttccctggcagatgcaaagaacgatgcgaggcgggattttgacgaggcgagatagccctccgagtgacgagggcgcggaaggtcgccttgaatatctgcgattcacattatcatgaagcctgggatattagatctcagcttctaacaaatcaaactccacggagatccgcctctttgacggcgacagacattgccgctgttgctgttcctattcatgttgctgtcgctgttgctgtcgttgacactgtcgctgggaggcatctaagtcgcagatgatgtccccgcaagaatgatttccaagcgagtctcgaaccgtgcagaggccttctcctcccccacgcgtggccgctccttccccgccttcaaagtcgcttgggtttgagtcttggccgccccctgtgccatccctatggccaacctcttttcttcgatctccaatcgcttttcctgaattttcagtcttttgagagccagttcatggtcttgtgcgtccttgacagccctcgcctccagctccttaagcctgatcgcataaagcatctctaaaggatgctgggtcatcagggtgttgagagtcggcgaagcctttggcgccgacttgtggatcacatcctgccacgcgccccagaatctgtcgtcgctcttcattcgtttttgggagcctctggacgccgacgctacggcagtcgacgatcctgctttcgtccaaacttcatcatcctcatccttatcctcatcctcaccttcagcatcatcatcatcctcttcctcttcctcgtcctccttctcagctcgtccttcgtcctcatccccttcttctccttcgtcctcgtcttcttgatctttgtctggtgacggaagccgccgtttccgccgaacgggtggtttggatacctgcgatggtggagcccgattgagccttgaacgtaacttggctacagcattaggctgattcacaaccttggctcctggcaaggaagcagaatgctgcaacgaggacattgggcgaagcggagtggcacctgatctgccattggatggtgattgtgcagaggaagcagatgctgttactccatctttgaaactcattgtgggggacaggaacgatgcgtttacggtcaattggaacgccttttcggccaactggaacgcgagaaagataaggttttttaatagtgggtctggaatcccaagcccagctctgctgagatttgccgctgaccggcacgaggacgggcacggctgctgttgctgtcgcttggatgcgtgttgccctgggcagcagatgaattaggtgaggcgacgtgatgactgctgctgttgccgtagagggtattgccggctgaagaatgattattgccgctactgttgtaattagtgtcgtcgtggccactgagggacgacgggtgttgaaggagctggttgttcgcgtacgctaacgatccctgcgctgggactgggtgctgcaactgatgatgatgatgatgatgttgatgatgctgatgttggttgtggtggtgtggctgttggtggtgcgagggcactcccaggtaatggccgccgttggctgtccctgttccggaggcagggtctattcccattttaccgagcttctcaagcaggctatcccgaatcttgaacaggccactggacttcatcgcagcacggatcgccgagttgttgtaacatgccaggttgttgatgcagttggcaaagtgctcgtacagcgcgagaggcggccaaaagatgccgcctgatccgcctacggtcagatcctggttctgaatgtgcatagacgatgtggggtcgggaagcgcaggtggagtggacgagttggagaatgaggccgaataccttgactgatgcagctgacgttgatgtcggcgaccgggctgttgccgctgatgaggttgatgctggtgctggtgttgaatatgcgtcgggcttgagccaggtggcgatctggacgctcctggagaatcagatgcatcgcgggtgagtagcgcattcgctgagaacgtcgatagtggtaacgacaacgtcgacgcacttgaacacgtcggggagatggatcctgagagtggcgccgtcaacccctcgcttgccaaagactcttcgccagtggtgcgttgatcaaccgagagttcctccgcgtccgtatcgccctcatcagccctaaagagcaccgactttgtgtcatattcatcgttgtgcacagagtcgccgaaactgtcaaggacaccactaagagctgtcgacacagcctccagtgcaagtcgttcttgctcctgttcctgtgctcgtaactgggcttgcaacgccctctcccgctcgagcgcctcaagccgcgccttttctgcccgtcgctgcttctcctcaaacttgcgcgagagttcctcgagtcgtcggaagagtatcacaaggcctttgcaaataacattggccgcgtccgtgtccaagttggggtttttgtcaaaccaggccagcgctgcctctgtcaatcgaagctgaactccaacatcctcatcacggctcacgagcgatcccttgttccgcacagtgatagagcccttccgggacagatcaaagatcatcatcttttgcatcatcccgtccagaacccccatcgctcggttatagctcaagttctcggccgcggacgtgacccgcaccttggccttatccagcatgaatgctccgacccaattgacccacccggcctcccataggatcctcatgttctcagatgtcatgagccgcttcaagtccgtcagagtgtgcgtgaccagatccgtgtggggtaacgatccagtgagttccaagatcaggcgaatcatactggcatatgtcagctcgtccgtgaactttgcggtaccggtgctgctcaaagaagtgctcgatgctgctgcggctgcgttgcctgtcgtgggtgggtttcctgagcccgcaaaggtgggttccgcgggtaccggattcattttgatgtagggcgcattcgcattgcttgagtgcacatgctttcttggggctgcagatccccgaggaatagtgtccttggcctccgctgtggcagatattaattcttgagcattagagtcgagactgcccacagtaaagctgctgccgtgttgttcaggtgttgtcgccagttgaggaggctctcgcatcggtagcgggggcggtgtcatggcaatgggcaacctttgatgtggggctgaggttattctgtctgccgactttctcgacattgcgacgactcctcccttctcaaacatacgtgcattggcatcacaccggtagcagttttgagccaagcccagaagtacttgaatgacgtccatggaaagcggatacttctcgagcgttgagcggatcagtccaatgccaatgttgggcttgtccagcgctgccttgcccgactttgtgttgtcactcagcaggatgccaatcatcttgagaatcaagatgcgaaagtgctcgttgggcgaatccagcagcccaatcagtaccgtcacaccttccagacccgatcctaaaagatccaccaagccgtggtccgttgtcatgcgcttgaacagcatctcgataatgtcccgtctgacctcgaacagctcaatctcctcatgacctataaagccaatgacaagtcctagctcttgcacggtcatgccgtccatcatagattccagagtccacatcaaaaatggtcgaagttgggctggcagagtcttgaacagctcgaacaacgtggtcatgccgaacgacgctcgccacaggcgcatgttctcgggcgactcaacaatcagatcgaccagggtgcgaaggatataggactgcacagagtcaatggtgtgaggtagcaggcgcaggaccagttgaacacacggcatgtttgaaaggataaggtgctcatccttgaccatgccgttgatcgcaatgtcgaacaggacaccaaagtgatccaccgagagctccgaggctgtgttgagcaggaggtcgtacatgatctcgtatccatccagctcgttttggaactgggcaatgttctctggagacttgtacagcagattggagatcactctgagccccaccagttgcagatgggatgggttcatctctaggaatcgaaagcatagttgaattcctccaatctgtccgatcaagttccgcattgcctgagtcatatggatggtcagtccaccctgaagaatgccttgggtcaaacgtttgctggggctgctcgccgatgggccaccactggtgtccagctccttgtccatgtctcctgcaaacccttcaggatccaagacacaaatgacggcactcttgatatcatgcatcttccaagaatccgtcgatgcaggtccaagattgtacaccttctcggcggtcgcttggtcccactccccttgcaagaagtgaactttgccggattgtccacaaaagtatccgagggaggtctcctgcacggtaagctgagaaggttggtgaaacgacgacgacaatgacgtggatgacattgcgtatgcatgctgcttctgaatatcatttggtaatgtcgagctgctgagaatggatgcttccttcatcaaaggcgagtgtgctgtgggtcctgaaatactgctccgtccctttctgcctaggacgccgaccagtgttccctctttctcctgcctgcgctggttgaatgttccataagactgaatcacgcatccgtccaccatcaacttcatggtcttgtggtgcacaaaaacaatgtggtgccagatccccgtctcggcaaagtcgaagcggtcaaacacaaagtcctcgggcggagaggggtaatgctgagtcctgacgcagaggcagtaccgattcgactggtccagcgacttgaagtaaagctcaaagatggtccttctcccattttcttcttcgtagcagaacaaaccggtctccttttcgagaaaagccgtgactttgacccagacactcacagtgtagccgcctttggccgacacaaccttgtccacggtgccaggatgagtcgtcaggctcgcattgagtccattaaagttgaagtaggctggcgggtcgactctctccgagatcttctcgatggcgtacatcatctgctgctccatctccccgataaagagcgggttgaactgaatgccagcaaaggcaccagagttgttgcctgagtagcgtcctcctgctttgcgacccgagtatgcggtgagggcgctcgctgattcggatcgcggtcttccactcgagtttcgccttgggctagcatcccggtcaaactttgtgggcagttccggaagaggccccagcgaatccttgatcgcactggcaagcgctggcatagtcttgctgggctcagacgtcaggcggtaaaacatatccagagggtcgtagacagcatcgaacaaaagccgaacatcctccacggagatgtcataggcgcccatcgctggtactagatctacatagggcgggtccgtgggtcttggtagataaggataccctggtgcgttaatgccaagtccatcctgctgtcggcctcgcctgaacaatatttgcagcatgaatcgtaaaccatcattgcgggcgagtaactctttgttgcgcggtgtgacctccatgagtagcatcaaaaggttgaagtagtccgtggccaacttggggttattgcattcaatgattttgccaagcagacgcaaggtcatccttgccgcatccgcgtccctgaacacgattcccgccagctgtttgaatgccatcctctccgacggcacaacggaatggaagccaaggtgagtcgtatttagaccgaatcctccgaggttgcgagaattgcttcgcttcctattggtgattccacctttcagcttctgctcttcaaagggccggttgccagtgcttccatcttccctaaactggacctccacgcccgaaggtgcgggtgttgagcgcccactgccgtggagatgcaggctgcttcttctcgaagaacctgggccagcaggttcgaaggagtccatgacaagctgcggcagtggcatggggctgctttccagctgctgctcctgagccgaagagatggaaatggatggtgtcacagagtttgaccagggtgacatgttgaagatgctgtatcgattgctgccgcttgaattaacgcccgcgttccctgaggctgcggaagacgagggagtagacagggagcttcccagtcctccttggctgcctagaacactcgatcctgcgagatccatagcctcttccagatacacactactgggcctcgacggagtgcctcttccgttcgtctggtaagccggagaccctccgtgcttatcaagttttgagagcgaagatgtcgaatcgcccactctgaaggagttgcggttgcctacttttctagggctcgtgaatgggagcacagagtggtagaggggctgcgggtctaggaggttggcaatgaacggccaaacttcggtacagtagatggagctgtctgactcgacatgaggacgggactttgttgacatgacgttaccgaccgtggctacctctagcacgatctcgcagcaaaccctaagtgatagtaaaaatgcattagcaaggcaagtactgttgtaaagtctaggttcattatggggtaggcacctcagtggctgtgcatcactcacttgtcaagtggccggcaggagtccagtacaatctccaaaaagccatcatagccaaagctgtcgccgagcagtgtcttggttccttcatagcctgcaaaaaagtcgccaatcgccacgagtgctgcagttgcaatgtctgtgtgttgagtgctctatatagcatgatgacaaagtcattagcgcctcgatgtgcaccgagccctattccatttcctgtcagggtgttgtgatacccttgaatctcacatgaacgagacttacactcaagacactaagaaggatctgcataccgcaggcctctccaaaggcaagcttcgaatcgctacacttccgaaagacaagagagactgtcccgcagatttttgtatacaggtaggccaacaaggaatgcgcttgatcctgttgcacatcttgctgcacttggagaaggccatggctgtatttgcttgtgccctttgcggtatcgctctgcctccgcagctcctcgattcccgatagagttgatttcagcatggtgatgatccacgtgatgatagacgcatttccagagtcctggagcgccaactctctgaaaagccacagggcaagatcggacacgactatgtcagagcggaaacaatcctgacaaagccccgggtgagccagtgaggccgcgtatgatgctgctggctccggcggctgctgctcgactgggtgatgacaggatcgtttttccagtagaatcgtacttgacaacgtatcaaatccttggagcagctcaaatacatcgacgctgtttcccatgcctttcagaatcatgcccaagatgtgaagagtcatcagtcgttgctcagtatgaacgcaatctcggagctcccgctcttgctcctggtcgtattccttgaagggtgtcactgacaatggtctgctcgccttcctactctcgagcattcgtcgcacaatttgaaggtagatgctagcaaacttttcctctataggaacgcccctagcgaccatatccgcaacgatccgtcctacgcttcgaagcacaatgttgataataatggacgaatcttccgggaaatcgatctccataagtaatcgggagagttcctataagaaaacgaaggaaggtgcaagtgcttgcatgatcagtacatgtcgacggatcaaaatgcatcgcatgatgctctcgtccgcttggttgtcccagtactgatgcgacttacatagagaatataaacattatcctgggtgagcataacggccatatactccaaaagtctcgtcaggcccacaacatactgatacacaggagagccgcgctcgatcatttcggcaaggactgcagtgtcttcagactcgacaaagtcatcaaagtacgtctgtccagtgaagacgacattcctgacgtcggccgagagaggatccagcccgatatgacgcgccatctcccactgagtgtcctgtagtgacttgctgtcgcatcggaactccagacagcctctcagcactccaatgaccatatcaatctctccgcatctccaggctgccactgcgttcagtccattaagcgagataagatcctggatcgcatacagagcctgctgtcgtacgtcgagttgcttcgactccagcagcagccgaaagaggaagtgataggcatctgtattttgaaccatatccctggctgatccgtccaaggcaaggtcgaagaacacggccatgagtgatcccaaaagaagtgcgcgcttgctgacggatgactgattatcgcgacatatctgctccatgccagcctgcgagtttgtttcctctagccagacctcttggctgtagtcgcttatggcagagtctgcgctcaatgagtcttgcgctgggtgatatgaatcatgcaccgagggtttggtgccactgtgtgggacgataatctcgtcaaaaactttgagtaacgtcgtgtagccgtccatcgctctaaactccagctggttctcagaattttggaacaagactttgcagacggtctccatgatgtcgatcttggtcgccagcctcgtccctgctgatagcggcggctttgacaatctcttggagctaatgctcgactgatgcgcgggtgccgagtcgctcaagatgcccattaatgagcgcagtgcgccttgtgttctcatgaattcctagattatcaaaagtagtaaaagcgtttgcgttgataacagctcgtcgtatcgataaaggagcatgagatatcgacctccatcaccttcgcgatgtccattttaccttgagaacgttgtcaggttgactctttctcaacagctcctcctcttgagctagttctacagcagctcctcttgtcgctaatgacagtgctgaggcgatcctgtcctcagaatttctacgcgtctctagagagggccgcttcgccacacggaaatcaggtgtggagaccatctttttgagcgagttcctttttgctagcttgcaggactctgcttctggctgtagcgactgaatctcggaaggtggaattaggtcgctttgttccggccgctgtgcagagtctggacgtttcggcagctctggcggctccgatgaatctgctgcttctgctgaactggttgcgtccacggatccgctgtcctgtccaatcagctgcgagtaatacgcaattgtaaactgaatctgctcagcattgggtatatagtgcttctccgtactcatacgccctgcttcgtcggtacccatccccagaatcccgaggccatcctgatctttgagttgcggaaagatctttccgagttcctgcacaaatatgcctcggacttcgctgatggcttgggacacccgatctatgccagtcaaactccttcctatgtgattctgtcgtcggggagtgtcgaatggggacattccacgaggcggctgtctatccatgacgaaggattttggtcgcggtggcaaggacgagttttgtgattgggaccgcgacagttgaacagacgatcgagagagcaaggcttttggactgaaactgatgacaccacctgtctttggctctgtcggtatttgcggggtagatatggatgttttcagaccgggtgccactagagccagatctgtcatgtccgagtggtcctcattgaattccagcaggtgattgactgtcctgacgacttcctgagtgagttccggactacctgcgatgagcaagcgaagaatctttttgtatccctcccgtttggctgtcacgtacgaagatgggtagatcgctattagagagccgtggaccgagcatcaaagaaaagcaactctggtcgcacacgaacagcatcgagcccttaccgatttcgatcttgttgcggtcactttcacctatcgtggctattattcggaggaacaggaccttgctcccaggcgatccaggtttttccaagagcgagagcagtctcgagatgaagtcgggtgcgtcagcgacaaggcgtcgatatctctcctcctgagtaaaacatgagataagggtggcattgtgttaatcatgctgtactggcaacactcgagtagtaactacagcaaaggttcgtgtaggcgtgtcgctaccttcaagatcaaattaatcaacaccagcgatctgtccagcggctcctgcatacactttgccctctctgactttttgagcgaggcctccctagcagcggaaaaccgtcgatgattcggagcagcaaacgacgtcagtcaacgcgaaaccagcactgacatttgacgctagcaacatgctcctgctactagcagcctacctctcgattgcgttaaacagtgtaatcatgatctctgaacaatcgccgtaaagtctctccatagacatgtcggtgtgctcctgctccacctggaccttcatctcgttgtacgcctcgtcgaacgtgtccaggaaggtgctgagctttagagcagttgcctgcacatcactgcagagcggggagcaagaacaagaacgagaaagcaaaagtttagcgacgtgtccaagcgctcagtacacggtagagttgtcctagtccaatgcgggctcttttcaccccataacccatgatttgttgacgctgtttaaaacccatgctcgcgctgcgtgccgcttccatgcgaagattgttctgtggttgcaaagtccgaaactctctggaaagaacgagagctatttgggtggtgcacgactggaccgcacacggttgccaggcgctataccgtccagtggatacagggttgcttccgatcgtgccaggtgtgagtcgctctaaaagtgtcgcacaaatatgtcgcaccatcaaggtagcgccaggggttgaaggtgcaacgaggtggctgctcgtctgctgggggtgatgcagagacaggaggatcgagatccactatgaagcgcggctgtatctacatccacttgccttttgtctgctacggcaacgtagtcctgccacactcgctggatcttcctgtatgtcttgtgggaggcccatttctggcggacgctcttcatgttgaggagcactgatgcatgcgctggtctatgatgccgaggattagctgcagagatatgaaaagcaggctggcagcggatgacgggctggtgcttcctagtcctgtggtcgattcctgcgtggccaggctgactggtccgtgttgatggccgaccgcagcgagagtgaggaacctgcagagaggtcgagcccaaagactgcagtggcagtagagctggacggcgagagatgaagaagggtgatcagagctgatgagcgggatgaggcggcacaggactgaggaaggtgccgacggaagggatgaatggcaggcgaggacaggcgaggacaggcgaggacacgaaaggacacgggagctgtgtgggatgcgatcaagatggacaatcagacacaacaaagaacagtgatgtggactagtagagtggtagaacaggcaaaaaaaaaaaaaaaaaaaagaagaccgtgttgaaaaaaaagggtcttggaaatcgaatcggatcgaaacgagtctgagggtgcggtgctgtcagcaaatcgttgagccaggacatccacatccgcatccacatccacatccacatccagatacatacgtgggtctgcagacagtgtgttgttgctcgctcgctggctggcagtggtgctggagacggtgcagtgacagagacagaagagcaacgctatcccacaggaaacaaggttcagacgacaagcgctgcttcccactagttgtggttgtgactatgggctgtcggtgcacaaccacaggcagcgctagggaactccaagagccagaaaagaggaacagaggaacagaagcgaatgcagacgaaggcggcggaggtgtgcgtgggggaggggcgacagcgaggacggagagagcatgcgcgccgtgaggaagaagaggaaacgaagccaagggaagaagggtcttttccttcgctggaagcaaacgttgatcgctctggcccaagtctcagagcactagccaagccaccccgcggtcactgcacttgaaggcttcaagctccccattcagccctttgtgtccacgccaacacgtcctccgccatccctggacctcgcacgcgtcgcacaggactccacatcagctcaacctcacgcacagcatcatggcagccagtgggcaggatcagcagcgcgagagccatctcatctctctcaaggtgatgcggctgtcgcgtccatcgctcgtcactggccacggactgtacttcaccgcgcccaagcccgcatcatcagcaccatcgtcgcagcagcctataccttccgaagagtccattcctgtcgcagaacggcccaacctgacatccattctgaccagcggcctctcggaactgtctctcagtcagctggaaagagttcacccgccctcctcagggatccttatccgcccaagctcagccaaggctcaaacagcggccgatggccctggtccacttgctggaatcgacaacaatgcagctttggacatgggcaactttggtgtctcggagctgctgaccatgccggcggcctttggaaacatatacctgggagagaccttcacctcctacatctgcgccaacaacgagtctccgcacccggtccgcgatgtgatcctcaaggctgaactccaaacaaccacccttcgattcgccctttccgataccctcgcaagtcagcggaatcaggcttcggcgacccggttaccctcggaatcctcactgaaatcagttccttcgccgtcgtcctcgactggggggcacattcaacttttggaatcgggaaaaacaaacgagatgattgtatcgcacgagatcaaggagctcggcattcacattttagtgtgctctattcaatactcgaccctcgacggtcagcagaaatcgttcagaaagttttacaagtttcaagtcatgaatccgctatcggtcaagaccaaggtcaaccacccaccgccttctacagcggctctttcggtacaggaccatacgaatcagaacatggcaggctcagcgatcaacatgaatgtttcaaggggaggactggtgatgctggaggcgatggtccagaacgtatcgggggtcaccatgtggatggaacggatgcgatttgagccagccgacgcctttacgatcaaggatctcaatgttgtcattgaggaggacaacagcagcgatggccaggcaaccgagagcaaagaagtcaagccaggatctgcggctagcatatttggcgagcacgactattttgcacccaacgacattcggcagtatctctatgtgctcactcccaaaccaggcaaggagcttttggccaagacgaccaatgttctcggaaagatggatattctctggaggtcacagtttggagagacggggcgtctacaaacaagtcaactcacacggaagcccgcgccgttggaagagattgcagtgcaggtcgtcaagatacccgagagaatccagttggagcaaaccttttccatcgaaatcgttgtcaagaaccagtctttgggaggaggaggaggagggtcgtcatcaccgcagcaacagcagcagcagcaaccacagcatcaacacaacagccatagctcacagaattcgctgtctcggcagtccagttttacaagtcagtcgccagcaagtcctatgctgggaggcacgcttgcaaggccacccgcagccgtggccagaggaggctttgttcctcccaaccgacctcttgatacccctgccccaccacctacctccgccacaccgagccaggtcactccgctatcgcctcaaccatcgcatcagcagcaagcatcgagcgcgtctcaggaccagaatgcgatgaagctcatgttgacaggggtcaagcaaaagatgggcgccattcttttgagcgggcccaacagccgacagctgggatcagttcctgcaggaggggaggttcgcgttcgattggattggttcccgctgacgagcggtgtgcaaaagattggaggcattcggatcgtggacattatctctggatacgctgttgagattgaccatctaacccattgctttgtggagcacacgtaatatacaccactttctacacaaaaacgattcattcatgataaaagtcgttctcgagagttcagctgcttacgcttctatttcaaaagccgatttttcgcctccgctgtttcgaagattcggtcgcttccaggtgcatgcgtccattgattgacagaggtgaacttgttgcgttgtggagcatgtatcgttctcgccacttgccccctttgttcgcggacaagagcgcgtaaaggcaacggtcgctcccaaaggttcagttgcatccagtctcactccctagaattaacgccgtccgccgttttcgttagcgcgaagagtgttcttttcgaagcttaacctgcccttttattggagaggaaggcgatttggtcgtgtccaccctgatcacggtgcattcttgtggatgtagaacagagaatagggagatgggagcggttggattttttggatgccaaaataagcatcgatttcaggcggctcgtgcatgaaaggacgccataataagggcagttgcgcgtaaaacctacattttttttctccgatccgattttcccagtactttagagctctaccaaccatctggtgtcccacaaaagatcgacgtgcagttctttttaacaaacagtttggccgtcccctctgtctcgtccacacccaaggaccaaccttccagcacgcttcgctacacgatgccctgtgcgagctctagtccctcgggcgaaatcgcctgaccagtccagtcccccgcctcccatccccccaattcattatagtgtcccgacgggcgtgcagaaggactgcagattcgacagtggagactgcgcgcgatcgcaccctccacagcaagggtagagacgtacgaggaaaaacctacaaccgaccgtagaagaaaaaaattaagatataaggtatgcgaggtataaagacagggctcattccacacaccgcctgccctcattccctggatctccatttcacacatcagatctcactacgctcagccaagtctgccgtactcactttcaactcgtcatgtcctctgaaggccaccacggcatagtaagatagccagtgatcatcgcaatcacgattgcccctctctcctcgagcaaacacttttcattttgagcaatgcccttaacatcaccattttcattatgatttcaaacagctgcctgaggtcgcctcagtacccagcgcctctgcctcaccctctcctaccgcacctgtcatccatgatcgccagaggctgtttgacccagagcaagggatcgcgctggacggcagcagcagcagccagcatgacatggcacgctgcgagaccctgaacgacccttcgtccgcttccctgccgcccccctttgacgaaatatcacactctattcttgatccaaacacaacacgccctcaggaagacgcgccagaagcgatcagccgcttcacacagatccgtagctcaaaacactttctgtccttcacggttgcgctggccgtctttgtcgacctcctttgctatggcatcatcatgcccctgacacccttcatcgtcgcagacctgggtctaaagtccacagccaacggcgcactgattgcctgctacgccgtcggcctactgatctcctcgcccgtggctggaattctctctgacaagatggctaaccgacgcacccccatgatcgtcggtctcatggccctgctgctgtccacagtcttgttcatggagggcttgaaacactactgggtaagtggaactgttctagaaaaaaaaaacacatactttttgtattgcccggtcactcgctttcagtgcattcaaacgaaccctactgacctgctcgcgcaaaatgtatccatttcaggtactactcgtggcgcgattcgcggcgggtctggcgggaggcacgatgatgaccttgggctttgcgttgctgtcggacacttacccttccaatcagttgggcgcagagatgggcaagatcatgattggccaatccctgggcttgatggcaggacccccgctgggaggaattcttcaggataaggtcggtcctaaagcaccttacgtgctctgtctggtgctcattgccatcgatctggtggcccgcctcctcatcatcgagcccaggagtgcaaaagtcaaggccatcagaaactttcaaaagcagcagcaaaaggagcaaaaggaacaggaactacagccatctgctctgactggaggaccagacgatccacagccttcagcaccggtgcctgcagccgcaaagttgaccaccatgagggggcttctgaagaacaagcgactgctgacaggtttgatcgtcagtttcactcaggcgttccttattgctggtaagcgggcgttttctgaagccgcaatcgcgtttgcccatcgacttgagcaacaaaccaaaaacatttcttaacatgatcataccacctcctctcgatattgtcagctctggagccagtcatgcctctttacttgtccgatcggttcaacctcagctcgacccagatcggggtgacttttctcgccatcagtctaccgacgtttgtctcgcccgtggcaggatggttctctgacaagcatggagccaagatcatgtgtgctatcgccatcctcttttgcgttgtctttgtcgtcatctttggtattccaggcctgcctctctgggctatcatcctggcgctggtcggcatcggagccacctgcgccatttacatcacccccgttctgggcgagatctcggccgtggtccgagtcacgggcgacggtgatggattcgcgcgggcgttcgcgctgttcaacatgtgcttctcgctcggcatgaccgcaggcccgttgttgggctcgttgatctaccaagagaccagcatgctgtggacctgtatcctgatcgcggccgtgacggtcgtgattgtgccactcgtgtttctttacatggggggtaaggaacagaaggagaaggatcaggcacagtacgagcaggatatgcaggaacaggacctgatgctgactaggatccaggaggagaagcgaaggaagcaggagcttgagcaagaaaacacgtccccgcacaacacttttattattgtagatcaaaaggtgtgatgcaatacgcgcactttgatacccatattcgcatccttgcatactgcgcgcacacatacattcccactctgggagggcttcacaataaagctgagtcatgtactttatctcacccatcatgccaagcaaggttctggtggtggtcctgtggaatgcagcttcgataggtggtgctcgcggcgacagacggtcttgttggaggtggacacgtcagagtgatcgatactgatggatgcaaactacgctgaccctcatttgtccttttcactccctgcttctacctcctttacgtaaagtacatgcaggttgagcaccacccttccttatgtcttccagcacagtcccttctcggcttgcccttgatgcttctattttcgctctccctggtttggatcattcccctccccctctctgttactgtacgtaagagcggtgtctcgctagcctgcttgatcacgcatataaaagagatcgcacacctacatgcaccgacccaacatcgattcctacactcaaaaccctcaactctccatccacttgaacccggcactcccttcacctttccccaagctttgttgttagcttttcatcatgcagaaatcaatctccaaagtctgtatggccgttctcttagctttcgcctgcttggtgagggtggacagcgctgagccgtattgttgtgacgccgtcgtcccatcgaccaatccagcagggaagattggtatcaactgcttcccaggcggaggagcctgtggttacagtatgcaagtctatgcctcatgcgaaagccatactgaatctcgcactgcccttaattgtgaataaagccatactctctctggcactgcccattactgtgaataaagccaaaaaaaaataaaaaaataaaaaatagaaatgaggacgagacgacatttgctgggaagcgtaacaggcttctacaaagattactttttttttatttcttgaaacaactccatatatcatgttccccatggctcgcgtgtcctgcttgacgcaagagcttgcgaaagctcgctctctggatcctgttgaacaatctcatatatgcatttgctgacgatcgtacggaatagtgccaacgaatccgcatcctctagcttgaagagccaagtatactgtcctgcatcttggtcgccagaagtgttccagatgaatccacagttgctctatagacgatcgatgtcagtctttggtcctctgcatatgccgccggtagcaagcgctgcaatgtcactgcgcaataaaaagaaaagaggtgtacttactggattgaatagtagagccatcctggtgtcgaccctttgacagagctgctgtctatccttgacatcgacaatggagagccaatctacatttacaatggtagcagtccattctcctgtgtcagcgcaaagccgttggatgacagagagtctgtgtgaaagtgacaggtgtgggttcaacattacatgtgcttttctccgagatgctagcgtcgcgtagaagctgacaggacaagcgggatccgcgaggcgtaaattgcttctggctcatgtcgaatagatgcagggctcccggaaactctgcaacgcattcatactcgtactcgtcctcttcgtccgaatcctcgtcttcctggtcctgcagactaccttctgatgttgcagaggatccgtcctcttgaacgtctgtgacagtgccaactgatagaaactgagcggcaaaggacgaggacctagacagaaaaaaaaataggtttgaaaccactcgataaacatgtgcgcttgcttttttgtgcaacgtgttcgggaatgtcgcacagacatcgaagagcaaagaacctgctgttttatacctgatctcaaattcccgaaagtcatcctcgtgcgctgtcgtgtaggattgctggtacttttgctcgtacatacattggtagaccgtaatctcaaagttgttggcatggtagtgggtcgtctcgtcatcgcatacaaatcgatagtaaacaccggcatcatcgccctatgaacaggttgcctgattagtttttccattgtcgaacaggaccccttcgtcctagaagctgctttgtgatttcctctagctgcaggtcgcttgcctcaatgtccctccatgtgaaggcggttgatccttgaaagatgtgacgatgaaaggccatgtcttgcgagataagaaatgtcctctgctcttgctctatcagtcgggttttgagatagaaagaatggcccgtcgattcgtcaggaaacccgagactggacctgaagcatgttttgattcgcgtcatgtagagcaatgcaactcacctggctcatccgtgggctctagaaaatcctcctcgccttctgcaaagacgcgctcgatcgttatatgagagacatagggctcggctgtccgctggacgatcacttgcgcgtcgatataactaggagcgtggtgaatcagcaggcgtcaggttctgggagaagtatggtgcggctagctccaacacacactgccctccctcccaaaaggagagaagagcgtttgtgaacaaaagacgacagcgtgcatacatgcattggccctcgtgatggggtctgtagatgtagaactggcctgcatgtagcatgatgcctgcgaccctgtcctcatccccgtccttgtccgaggcatgcccccagatgaggcctccgagggactttagcatggagtgcgactaatgaggcgaggtggatccgatgctcagctggcgcagatcgcgtggcatgagtcgtgtggcccagggcgagggtgagagggagaaggagagggaaagcgcaaatgaactcaggcctcagagcagtgcacactcaaggcgcgaaaaaaaaaaagaaatagaagcaaggggtcagcagcgctccacaagtgcattggctgtgagcacaatgcagtttacgctgcctttccatatgtgcacactgctcctccagtgcgcaaaaattcagggagtgcagggatgtggaaaaaagggccttttcgcgctctcatcctcatccatccacccatcctcatcaccatcctgcaatccacgccagacacggcagccacagcaacaacgccccgcacacctccgcagcaccccccgcagcacagagctatgatgaccaaactgctcgagaccccgccgctgatcaacattacgcccttgacccagattcacgaaggtgcgtccttgctccgtcacagtgcggaactgtttgcggcgacctattgacaccctgtgttgccacggcccttggcggtccaaacaagcacctctctacccatctgcagctctttctaatatggccctagggtctgttctttgtaactattgctgtctatcagtacctatccacatccacaaccccatccatccaacctcgaccaacaagcacaagcgacttggactgcagattttgaacgagcttagccgcatcgagatgtttgccatgaggatagaggcggttggaaaggtaagaacaccagtcatccatgctccctcctcctctaccactctccattctctccaaggtttggttctagctctacaaaactactcaacaccgctattgacgctacgaatgactgcctttacagcaaaacgaagtagaagcagagctgataaagacagtgacacatctggagcaagtcctctacaatttcgagcaggaaaacggaaaccccaaccgcacggatgatccaacaggtcgcgttctgctccaggtaaaggcctgcaccccatcacgttattggctgaaagctcgcattgtcatccgtgtggcccgccccgatcgatgcttaccaaaaccccctcactcactctctatcgtgtatatgcatgaccaacagagatatatgatcagaaccggacttgtagaaatgtttccaaagtcatcagagcacctcgggattgaccctataggtcccggaggaagttttctagaaggtacatccttattttgaacaaaagtcaaacccccgccccctacttgaatcgctctcattcctcagtattgagccgtccacttccacgcgtcttaacaccgctcttttcataattttgctctcctggacctgtcctcgaaggccatttgcgacagatggcttccgtcaaccagctcgtatcaatagccttgcagctacagaatgacctcaggctacccaatcacaagtttattgcgcatcaagttgcactgctctatgtaagtgctcgatcgtgtggatgccatgtgtcaacaactcttctctcactgacaacctgcactgttattcttattagcaatgtatcaatcaagctggacaaacttttatgcagttcaaggctcgtgtggaggagcaattcaacgcactcaaagagttttgcaatgagtccgaggagccctacttgacgcctacgttacaatcctggtaagtgctcttgacgctctgcaatcgctgaagttcattgcatctttgaggaatgcgcgtctatagaatagtataagacagctaactcacgcgcgtcccaatctaggctgacagatctgaccacggacattgtagcagaggccctgtttagtgggcgacctatgtcgcagcagaccccgcaagcagctcctctttcagattatatcaacagagtgtcttcaggaaacaactgggatgagcatatggaagcgtcctaaaatacagataccttgtaaacatccacctcaccgggcttgacacttgaaattcatttgaatgcctaccatgcacagtctcctcattcgcgcatttctattggccgatcagggcatgatcgtccgattttcaacctacccagggtgaaggagctatcactgtagaacgcgcattaagctgggcgatgaataaggtggtcattgaccgttctaatttatatgtcgccatgttcagatcttgtcaagtccatgcatgttagaagttaacaagcgcacgatttagagggagcggtatacctatatgcgatcagcattattgaagtctgtcgcatcacgtacgctgtcccagtcttgtagcgccaacatggcggaagagcataaccttcgattccgactcgctattatccgattagtttaaaagacttgcatgtctggcctagtatctgtctgtaaaccaatcctctttctagatagatgccagcgacattcttgttcctagcgcaacggatgtttcccgggtctccaacgctgtacccatcatagcgccaggagcctcaacgctatctgcgacgactctttggcgcgttgcatagtgtttctgtagcgtcatatttcaagtcagatagaattcagacatataccagcgcccgtacactttcgatcatggccagttctttcaaatggttgccgacagtacaaaaacgatgatcatgcgatgctaccggcatggttggcgcctccagagcgagggctttcgacctgaccgcgtgaatcacttgtccgagcaaattcataaatctgctgaatcggccatgtcgccatggtcaaaggccccctacccatggagaatgggtcgattcggctactcgcgtggtcaagatcgccactctgtatattaactgcctcacgccactctccacactctgaaacctcgatgcgaatgcagattgaggatcattctccaacattctcattaggcaagtcgccgtctgaagttggggtaagctgacgctagattgctatcaatgagagtgctggagagtactctagggctctcaacgggtacgtagcgccctgggtggcaacgccagcgaacgccaggcactccatgcggcccgcacgcctctttggcacgtcgcacggtggttctacagcgttttatttcagtgtcacagtgcgaaaaccttaaactaatagctgtcatagtgccagtggcccacataccttcgatcagggccggttcttgcaaatgaccatcgacagtgcaaaaacgattatatttcgatgctaacggcatcgctggcttctcgaaagcgagggctttcctcgcagctgcttgatattcaaatataatggattattagaaaatcctaaggctagcagcatccagggtaccagcgcccatatatgtttgatcagggctgtttctttcaaatggtcgttgccagtgcaaatacgagttataattcgatgatgctggtaccgttggcttctcccgagcgagcgctttctctcgcgcgcttgatattcatattgtaatagtttccatgaatttggtccttttcgcacccgttcatcgtctttctgtgtttgaagagcagctcgattcagcacgtagattgtcgcgatgagcaatcgctgaaaacagtgcctcaagatgttcagcacactttcacaggtcgggaaaagcggctacaacaatcaggcgccaagaatcgctttagcccgcttggcatccgagagctgcgcgcaggtgttttaaagacggtgacagggagcgaataggacccaattcacagaagcttttacaatgtgtatgttaagcgcatgggacaagcgctcgctcgggagaagccaaccctaccagcagaattgaattataatcgtttttgcaccggcaacgaccattcgcaagaaccagcgctgatcaaagacagaaagacgctgagcgggtgcgaataggaccaaatccgcggaaacttttacaatgtgtacgttaagcgcatgggagaaagcggtcgctcgggagaagccagccgtaccagtagcatcggattataatgtttttttttgcaccggcaacgaccatttgcacgaaccagccccgatagaaggtatataagcgctggtaccctggacactgtttggtttaaggttttcgcgctgtgacactgaaataaaacgctgcagaaacaccgtgcagcgcgccgacgagtcctcgcggatcgctttgagtgcctggcggtgccttcgagggcgacaggcaggcatcgagagccctagagtactccagccctctcactgatagcgatctagcgtcatctaacccgatcttcagacagcgactgtgctaattgaaaagttggcgaatgatgcgggtcatgcatcgatgtcgaggtttcagagtgtggagaatggcgtgaggcagtcgagatggcgattggagatcttgacgccatgagtagccgaatcgacccgtttgccaagatgagggacctttgatcatggcgaatcttaccgatttttgaatttggccggacgagcgattcaagcggcccggacgaaagcctggctctggacaagccaaccataccggcggcactgcctacagatcattcttgcactagtcgacgagcatgcgcaagtatcggggtctgatcggccaatgaaaggcgccgaatgggatatgtggatggtccgtatgggcccatatgaaggtgctagggctcatagtaaagtagtagtacaaaagtgcttgtgcctgaactcgatttttaaggttttcgtgctctgcccgtgcaacaattcgctgctaaaccaccgtgcagcacgtataatacgccaaagagtcatcgtgggtcgctggcgccgctgtccagggcgccaggcagccattaaaggttctagggcccctcgcagcacaccaccctatacccatacactaaaacccctgtgcgctgctttcggaggtgagggtgggctaatgcgattcttggtgctgatcgttgcaaccgcttttcccgacctgtgagagtgtgctgaacatcgtgaggcactgttctcagcgattgctcatcgtgaccatctgacttgcggaatcgagctgctggaacaggctgccccagtcttccaagcactggatgtcactgatggctacacaaaggacgacctccaggctgctcacacagagctgcgggctgcaaacacagcctaccaagatcagcaaaaagccagacgccgggcaggatctggccacgcgcttgcgaacaacgtcccacctcgagcacttctgcgactctccaagtgcgccaagatgccccgcatatggaccttgctctactggttcaaccgcatgccgccctacggagtggaatgcgcggcgtgcggcgatggcatgacgatcagtcgtcgccacatccaggacggctgtctcctctggcaacaatatgctgcctcagactggtacaaagagcccaccaaccaaaccgcacagttctggttggacagatgcctcctgtctgcaaagaccctcacgatgacggatcccttcttccggtccgcggccacgtacatatggcgctttcgagatcactgcctcaacctagccgatccggacatagatgccagttggcccgcgcctcctggtcctcaagagcccccctagcacccccttcaccctcgaagggtacacagatccgccttcacaggcacttagtttagcttatatatagccccccgattcaactgcccctctatagtaccatagttaggaactggatcaccaacatcagcgggttcctttgaatagtatcataaagtgttaagaatcaaaggcagaaagacgatgaacgggtgcgaaaaggaccaaattcacgggaactttgagaatgtgaatatcaagcgcgtggaagaaagcgctagctcgggagaagccaacggtaccagcatcatcgaattataactcgtatttgcactggcaacgaccatttgaaagaaacagccctgatcaaacatatatgggcgctggtaccctggatgctgctagccttaggattttctaataatccattatatttgaatatcaagcagctgcgaggaaagccctcgctttcgagaagccagcgatgccgttagcatcgaaatataatcgtttttgcactgtcgatggtcatttgcaagaaccggccctgatcgaaggtatgtgggccactggcactatgacagctattagtttaaggttttcgcactgtgacactgaaataaaacgctgtagaaccaccgtgcgacgtgccaaagaggcgtgcgggccgcatggagtgcctggcgttcgctggcgttgccacccagggcgctacgtacccgttgagagccctagagtactctccagcactctcattgatagcaatctagcgtcagctgaccccaacttcagacggcgacttgcctaatgagaatgttggagaatgatcctcaatctgcattcgcatcgaggtttcagagtgtggagagtggcgtgaggcagttaatatacagagtggcgatcttgaccacgcgagtagccgaatcgacccattctccatgggtagggggcctttgaccatggcgacatggccgattcagcagatttatgaatttgctcggacaagtgattcacgcggtcaggtcgaaagccctcgctctggaggcgccaaccatgccggtagcatcgcattatcatgactttgtccctagttagcgaccatgtgcaagatcctgctctgatcggccaatgagaggcgccgaatggtatatctgaatggttgctatgggccatattaaggtgctagtagaaaagtgcctgtgcctgaattctattttttaggttttcgcgctcaacccatgcaataaagtgcttcaaaaacaccgtgcaacctgtatagcgcttcatggggcctactctatcgctgtagaggaagtgcaagctagccaacgcatcattcattcgcggagaacgttgggcctcagctggcttggccatagcgaataaggatgctctatgactctgagagcaatggtgacgctgtttaccgtttgcttcttcaataaggtcattcaaggatgattgcagtatccatcagacgatctgacgatctggcgtcgtgaatacagcccttcaggctgaatagtagggcttcctgtccagtcaattctttgaggcgcgtaggcagactgtgccaggtcaagaatttcaatttaaggggagggtgtaggttgtcaagtgtcacgatgaatccctacattcaagtctttgcgacgacctgacttccacttgcatcatcattgttagacaaaactcgactatcccgcccacaaaacagcacataaaagacgaacgactttcaaaaactcaatagtcaaacaaaaaacgaacgcaaaccatggttcgttccactccatcatttgtggcagcccctaacatgcactcatccaaacgaggcgacaggggaaggaaaagaatggctgacgttgtcttttatagtgctccatgatgtcctgacctatgccttttctgattgtagggaatagtcttgacaaaactttggcgcaagctgatgagcaaggaggaggtcaaaatagtcattgtaggactggacaatgcaggaaagacaactgtcctgtacaagctgtaagtggacgttggacaaagcggcctgtgcttgatatgttccctcaggatcacaaggcctcgactgacggatcctacttgtactctgtgtgtactttagccttctgaatgaggttgttgtgacgacgccgacaataggaagcaacgttgaggagattacatacaagaatatcaagtttctgatgtgggtacgttcattagtcctggtttctttgatcgccgccgaactggaggatcgaatgaagcatggtctgctaatgcgaatggcccttgtttgcaggatataggcggacaagagtcactgcggtcgtcatggaagacgtattacgtcaacacgaaggccgtcatcatggtcattgatagctcggacaaggaacgcctccacatatcaaaaacagaactgcacacgatgatggaatccgaggcaagtttgaagcatggagggacaaagcagttgacgacgttcgagtcgcacagtggtttctaacttttggatgttcttcgctaatatgcagtcgctccggaacgcaagcctacttgtgtttgcgaacaagcaggacgtcaaaggagcactcagtgcagccaagatatctgaagcgctggcgctcacgtcattgcaggatagacagtggcacatccaagcatgctcggcgttgactggagacgggtaagagcgtcgtacttgatgatcactgcgagatgtatagagcgagtatttttatggcagggcttctaacgctgtgtcacctctgcggcgtgctttctgacatgatgtagacttttcgaaggactggactggattgtggcccatattgcatcgcagtagggggggccctgcgttgcctgtcctctttgtactttgtcggaccagacgagcacgctgctgctatataccgaccctcgacgaagcccagagaggacaagatcgaccacgccgcaaaagactaatatacagaagtaatggttgtgcgatgtctacttgcgtactaccgtgcatccgcagcagcttgaggatgggtgtggtgtgcagtgatggagtagtagagcacacgtaaagtgtaaagtgcgggatatttttgtgaacactggtgtccgcaagggtactgctgctcttgctgctggccgtttcgtgctgttccgaattaggaaatgcgcgatttctttttctttctattcgtagttctgctccctgtcagaccaaccttcaggttctttctttttattttgacattctttttcttccaaccacaacgaacaatcacaatcacaatcacaatcacaatccacaccccggcggtcctcttttcttctgcttcccccttcctgccccttccgctctcccccagtccgagtcctcgtccccttcatccgctgtctgccctgcctccggttccttgcatccgctgaatccgtctgcgtcacaatcgtctttgacagctcccccttggccccttttgcgccgcccccatggagtcggcatccgtcagtcccagctcagcatccacggcttccatggctcgagtggacaacagctcctccagcagcagcagccatggcagcatcgacggcacacacgacacctcccacccctccagtcctggcccgcagcagcccggggccatgtttgagagtcgagggagtctcgataccctcgcagccgcggccttgaagccccttcctgaaaaatacgcaccgcgccaccgcacctctcaacctccacacggccaagcgcaagagcaacagcaagaacaagagcaagagcaacagcagcagcagcacgactcgacaaagcaatcgctgctcagtagaccttctcatactgctcacggccatgagggccttgaggttgtaggcagcactgggaggcattcgcccggccacgaccacaactcaagtagcgcgagcacatcgtcgctgccccgccctacaccccactccgaggagcacccgtccaaatttcattatagggatcagcgacagcacatttcagacgaagactctgaggacgacccactgcaccgctctcgtcaggaccctcataaggagaaggaacatcgttcgtcttcaaggcatcgacaatctcctgacagtagacacacgggaaaggtaaccgacgcaacctatccgcttgacggagtgtcaagtcggactcgactctaacatgtttactctgcaccgacaaccactaacctactttgaaccgtccgtctccttgacgcgatttttgaatgcagcctaacgggaggtcgaccatgtccatctcgtcgttacttggtaagaataccctggccattgtttgtcgaaatgtcaatggtatctcactatacatgttccctacccactgaccactgacaatctcgcccttctttccacacgcccacctgaacaaaaaaatcaggcaactcagcagcgcctggatattcatgcaagcagatgaatcagacacaggcacaggcacaggcacacacacaggcacaaacagaggcacattcaagccccgaacgtcatgcaagtcatcagctagtcccccatcgacacaacgatacccaacaggatgacctggtacacaggcgacctgaagagagcaaggaatcagaaggtatgaacaaactagtttgtctgatgcgaggagaaagaactgtggcacagaatgtttatgctcgagttcttttcctcaacccttgtcctcagacaccttaatcaggtcgcagagcgataatgccagggaccagcggctggcgcaaggacgacagggctcgaacccgcaccagcaccaccatcaccatggtcatactcataatcctacgcaccgccaccatcaccatctgcaccaccgcgaagactcagggctagctttaccagcggctgaaaaatcaggactaccacaccaccatgctgcgcaccaccaccaccaccatcagcgcgcccatccacacgtccatcaccatcatcacccacagcacactcaccagcatcctcatgcgcatgcgctggcaccacatcatcaccatcatcaccacgcccaccatcatcatcttcaccagggcaagtcctcgacaacgagcaagtcagcattcgcgtacatgcctagatcaattggactggtgagttgtacttctccttccgatttagaactgcgcatcacatttacttgtgccagctacgtggtatttatgctgtaccatttttacgatctgatagagtctcaaccctcgcctcaaggttaacgcgacacaagtctacatatcttatctcatccaacttgatcaaatggtatgcaagctgcgtctgaatttgatccgcatggttacagctgcagtaaagtctctctaacaaatgtggacccatctgtacaaacagcaacgagcacaacaccttatgcggtcatccgaaaagagaaagtccgtgcaggatgcatcatcgagtctgaaggataggtcgcagtatgccaatcaacctgcgggtcatgctcacacatccagcacaagcgaggtcattcggagcaaccaggttgacaaataccggggggagaagggggcagcttcacatgaaggcagagcagcctctccatcctctgattcagaggagcgaaagaggcgtttctcgtacaattctggagcgaccggtcaaagttcgttagagatcgcaccgccacttgcagagactatggtagtggccacagagcgagcctcgcccatagtctcgcgagcagtcgagcatgcgcaccatcgtcaccagcatggccacgtgcatgtgcaccagcacactgctcccgttttccctgcacacattcatccggcgcaacatcatcaccatgtcgtaccgtcagcagcctccaaagcggaaaagagcctggttgtatccggcaaatccaacagctcgcagtccgtccatcggcaccacacgcttcatcatcatcaccctcatcatcacccctatcacccaagccaccctaatcaccagcaccactttcaccaccactcgcatcctgctggccacaaccacaaccacaaccacaaccacaaccacggccacggccacaatcacgcccttgttcacggacacgctcatgcgcacacgcatggccatggacatggacatggcccagggcacgctcatttgcatcaccacggccgtacgccgtcaacaggccatactagccatgtctcctcctcgcggactcattcacaccgccattcaaaatcaccgtcctatcaaaagagccccagcctcgagcgtgctcaacagcaaaagcgtgagcaacaaacctcagatcaggcacggcgccggtctcagattttggcgctcccagcaccgcagccgcagctatccacgtttacgagtggttcgtcctgtcgggaaggcttcgcagtagggtcagataccaacggctttcatcgtccttcaagtccgtcaatacagaggcaggataagcgctcgccatcgccagcgcatgaggatgtcgaggaggtgaggaccacagccatcgatgatcagctaccgcaatcacatcacgatggatgtggttcgatgcagcactctccacccccactggcggcaaggaccgagaatgccatgcatctcgactgagttttgtaaaatgttatcaatcttccttgcatgtttttttctttgtatataaaatccacaccaaactcgcgctattctattcgtattctcgagctttgcgagctgcattcatgagcgagatccatccgacaatgtcggctccaggtttgcgtccgaggtcagggttgcatactgcttctgctggcgcaccatccaagcagttgcgaatgcgatctaggcgatcgagcgcgagtcggacgctctcctgtgcagtgcgcgcaatctcaaatacgggtgcattccatagcgacagccccgcgcttggtgcctccacagtggctcctgtgagagggtgcgcttggtggggtggaagcatcctactcacaggcacgcgctcaaaaatgtacaaacgatcaagacctgcgattgcttcttcatcctttgagagtgcggtggccgtcacagaggcaggagtcatccttttcatgtcgtccttgagtgagaatgtgaaggtgacgaattcgcggtcctgaagctggagtgtgaagacgcagctgcttttgggaatgatggcatcccttggcaggcacgagtcgacgatgattgaacacggatgtatctgggcctctggcgcaagaaccacgttttcgatgtagagcggtgactgaacggctccatttctggtgtccgcagggaggatgtcgttaggttgagagaccaccactgctatgccaaggtcggtgtttcggatattgagctcgtgcatgaatgccttgtgggtacaagtgccttcgaggaactcttgcatggttccgaggtgatagaacttggatgcgttcaagaccatgacgtccagactgacgccagcctgctgaagtaactgtttcaccaggtgtcgtccctgaacgtgtggcgagagcgaggaaggtgctgtcgagtcctgagcagaggacagggatgctggatgttggtcctggaagctgaggatgtctgcccatgcttccaaatcacattcgggatgcagactcgagtacatctaaatggttcgattggtttccagaggacttgtcaacgtcggtgatggaggctgcggccgaaatgaaagaagtaggcactgagaacgccaagtgatgatgcggagacttacatcggccatgaggttggctgtctgcggatcaaaataatagcagctgtcggtgtatacaacgtcgttcgcgctgtcattgggatccgggtagatcaccctgggaacgctcttcatgacatctaaacgcgtgtatacaacacaaatgtgctgtcagagaattcgcccacgacagacgggcaatgccggaaaaaaaagcactgcactgctgacattatagcgttattaccgatggaaggcttgtgcaagaactgttcacatttcagcagcagcgcggactggtccctggggtgcaagtctctgtcgtgtgtgacaacattgtcggtatcatgcagcaggtagacaccatgagtgcttcctatctgcgtggaggatgggtgggccagtgctgtgatcgtgaatggcttgggctcgctcgggaagggtgtgtttgacgagaagagttcgatcccatctgcgctggtcagaaagacctaaaggacaaggagagagcggtcagcacccaatcctgccccacatttacataccgtcgtcttccgttgcacttacgccaggcggcattgtctccaggagatggaggtaaagaacgagcttgagttccagaatctggataccctctgcgcgatcagctatgtgttgtccaaacgattcggtgcgctacgtgaacgctgttctggtctggtactgtgtccttatttttttctggtaaacgtaccttgtgggatcgtcataaagatcttgccccgtgcgctgatgtggggtagacgcgtgctgtagccgcccgcgtgaactaggagcgtgcgcgctgagtagagggcggagtgtcaagaacaatggtatagttcacagttgactcgccagcattgcagtgctcacggttgcccttcccccttacctttgctcaggatatctgcagggtagtgttcgcgaagtactttcatgacaagacaggtggagcctccactgccaatctttgactgaggtgggtcatcaatgacatggtatctacgagccaggaatgagcttgaggttgtttttttccgacaacgaccgttgaactttaaaaacgaaagacgtaagactgcaagaatgaacactgattcaccttactttgcacgctgcggaatgaggcctttgaccagcttttcgctaattctgttctcatagcacttgcgttgctgggcatcgccggctgtaatgaccacaatgtcccagaacgggtcctgtgcctgagttctgggtatggcagtagctgggtgtttcaagagccgctggtagattttcagattcttggcgtgcactgcctgaagtacttgggagaggtcgtcgatgccagtgggatgaggcgcagcctggttgttgctgctcatggcatgcattcgcgctggtgtgaggtgagatggactagagcatcccggacttgggcggcgtgggggttcaggaaataggttccaaccttaattgtcacggtagcgttcgcacgcaacctaattgatctcacttccgcatcacctcccatcctgatcaccccgtcagactcgaggccagcacacgagattcagatcatgtcagagaccgaacaggacaaggctctgccctacaagagcgacccagtccgcgtacaagagctacgacgcctgctcctcaaatcaatcgccaagaacacgccctgcgactgtatcctcctctcgggaggggtcgacacctccatcctagcagaggccgcctttgccgtctacaacatcaacaaagccgagaacgaggataaccctacaccgagaccgctctcaggcgccgttacggttctctgcacggatcaggcgacggacgagttttatgcgacgcagatctcggctcgcttgggactgacgcaagaggtggtcagaatcacgctggactcggttctggaggaactcgagttctgtatccggacgcttcagacatttgatccgatggagcttcgcaacggtatcgtcattgctaggggtctgtccgtcgccaaggcgttggggtacaagaccgtcatgaccggagacggggcggatgagctgtttgcggggtactcgttcctgcacaacatgtcggcggaacgtctgcaggcgtattcggacaagctgaccaagatcatgcgattctcgggcgtgcagttggccaaggctttgggactgagactcgtgcagccttaccttgacccagagctgattgcgttctcacagcagtgtacgcgggatgagaagatcaattaccatgaccaccccgtggaccgagaatggcaggatcgactgtcgggtcgacagcttcatggcaagtttattcttcgggaggcctttgaggaggaggcgttttcggcctggcgaaagaaggagcccattgaggtgggctcggggacgacggttctgccaaagctgtttcaagagtccatgttggcggaggacctgaagaaggagcaggatcgtattctcgagcaggaggggataaagatccgggatgtggagcatttgcagtactttaaggtgttcaagaaggtctttggcgaggacatgagcacttacccggagaagctgaggaaggatggtcgagacccttgccccgggtgtgggtttaatctctcgacgccggatcagaccttttgcgtcatctgtgggcagtggccagcgcgtgtcctcccacccccagaggagattgcaaagacgaacgataattctgaataaatgcgttgatttactttacatcaatcattctcacatccagcggaacgttgcctgctcaaattccttcttatccttgccttggcattgagagcatcacggtgcgtggcatcaaagcgatgttgtaccgtacataaaacatttattgtgacaagcccgtggcgagactgtaaagagcagagaacagagaatgagaattgaatcactgtctcaagatgagtgcgtgttgttctgaagcgcctgtagttccctgcgaagctggcggaccgttctttccagacgtcgtcgttcctccacctccttccgcaccgccctctctttctcctccctgagttcggccatgactctcctaaattccttcctcaaggctgccgtcgcccccgccactgcagcattgttgctgccactgccgaccgcgagattcatactgctgctgttggcgctcgagggcgtcagattgggtgtgcttccgttgaatccttcctgcgatcgctgttggttgtaaaacacctccgcgctcgacggtatgggcgacgacaatcctgaggccgtcgcgtcctgtggaatttgctgctgcttctgcaccaaggatccgaaattcagagagcccatggcactgctcaagccaagtcccgacccgaaccatgatccaggaggagaggtctgagaggatgatagggccttcaagagctgcgatcccgacccaggcccaccgttgacgctctcgagagcagcaatgatcatacgcatctctccgacctgctcctccagtttcccgcacttgatcctgaactcctccagctccgcgacatcgaaggaactcatcacaggcaaagcgacgatgtcggctccatcaccccatccattctttttgccgtggttgccagctgcatctgccagctgagactgaagccgctgaagcgctgcatcttgctcccggatgagctggtcccgttcctggagcagtttatccttgattcgaatgatctcctgcaagtccgaggcgccatcggctgccggcttcccgttaaagcccccatactcggaggttgagcctctggatgaagccgtggacactccggtcgcactcgctgccgctagttctgccaagcgcgcgttctcatccagcagcatgtcggtgtgttgtttcagcagttccagttccttctccagaagttgaatcatccccgagctcgcctgcagacgctcgagttccgaattcaggatccaagttgaatgtgcagggggttgcggtggagaaattacttcttctgctgctgaattcttgtcaatgagctcctcctgctgctgctcttggatatccgaatctgccactgtcgaggtgtgaacaagcagactctgaccactggcctgacgactcctcgtattcgaacgactgaactgctgcctgagctgcacattgtcctgctccagtagctgactatgcgccaccagctctttcacacgcgcaataagggcgtccatactgaacccgaccgcacttccggacgatagcgacgagacactgccagcagggctcgcccttcccgagatctgggagaattgtccataaggactcgtcctacctgggctacctcgacctccaggactgctgctactgttgacgatctgctgctgatgatgctgatgagacatgagcagctgcatgtggtttttccgtcgagggtctggaataagatcaaagagctggcgcatcgacttgttgctcgattgctgctgttggttgagggtgtcgatttcatcaatggcctcgcgtagttgtgatctcagtgcctggatggtctcctctgtagacgcatgcgctccgtttgcgccgctgcttgaatttgcgactgacgcagtgtttttctcagcatcttccacagcgacaagactctgttccaatgcgctgatcctatggttctgatcgtcctgccagcgttgccgctcattctcgagctcctgtcgcgccatctccttttccagcagggcatccttgagactcttctcgagcgcggctcgaattgtatcctcggcctgagaacgatatgatgacggaggtgtgcccttcaccctgacactgttggtccggctcgcgctcaggactacggaatgtcgtctcaaaagaccgagctcgccctcgaggacctgcatcttttgctgagactctgacacatgactctcgagcgcgtccaggacggatgtgattctgtcgatagagtagtgaggtgacgaagtaaacttttctcccgatccagggggtgtgtttaggccttttgatccaacggctgtcatctccgaaacggtagccgtgacagtacctgtcaggttgccatccgagggtgcggacgataaagaatcctcgcgaacacgggctagggcacaagagtcctgactttgccttggcagatgtgccctgttgacaagagtcgcttctgagggccaggtctgggtcactctctctcttgatccagtgtcgccagtaatcgtcgttccagcgctgtccatgaggttcatgtccatcctccgatccgaggatccttgcatgcgatggtgcttttgctgctgttgttgttgctgctgctgctgttggaggatatgttccaatcgcttcccaaccgtcaccaagaagtcgcccatttcctttacggctttggagacatcactatcgttgttaccgagagcatccagtgtcttttgctgtagtcgagaaaggaccatggtcttttgttgctgctcatccatcttgacaaacaactcgcgctgatgctccagctgcttcatcagtcgttcaatggcccggtctttttcctccagcagcccctgcgcctcaagagcatccgcttccaggctgtggatagtggtcgacataacagcactatgtttgcgttatatatttccagtacacggcgacatggttagtcatccctcggacatttcaagtctgtacaagtttttcaacggagcaacctgcggatgatgtatcgatgaggagggggcgagggcaacttacaattgttcctccagattctgctccgccgagagttcctggatctgtagtgcatggacttctcgttctctcctagcttgatcttcgaggcgaacgacgccaagcgccagaacccctgacgtatgctgcaaaagcgtgcgctgcaaatcggccgccaactgggtcaatttccagagctcggtcgctacttgatcgactttacggttcgctgcttccagatgatcactcgcttgacgcgccagctttttgttgtcggcatggagcgtcagcaacgactgcgccgcctcacggatcttggactctaacgacagccgtgcggtcagggctgctatcctggagctgagagtggcatgatgctagcatgaatgttggaaagaaaaaaatggcaacaagttaggaaaatggaatgtcggccgagttggaacgtgtgagacaacaacaacaaaataaaaaaaataaaaaaaaaggtggagataatgaagggctgaaagatcaaaaacatagtgttgcaaatcggtgctagacaaggctgtagtttgcgcaactgacgacacacttgtgcactgaaaaaaaaggatttcaaaccaggcacttacccgcttaatgctctccacagtttgggggacaagaacctcaaaccctttagcgtccactgcagcttgggagatcaagatctgcatggtgatatccgcttcagagtcaggaccgtcgggctgagaaaggtaacgctgcatcaacgccatggcagtgcgatcctggaatgattccagtaaccctgttgatcttgaggggctggtcgccctcgaagaattaggtgaccggcctggcgaagtgtgctgccgttgctgctgctgctgttgctgttgttgaaaatgatggtgttgttgatgatgagtctgaccgcgttcaccttgatactgatttgcttgatgtgaatggtgctgcggttgatgatgctgttgctgctgagaaggtgaatagtattgctgacttgtctgaccgggaggctgataccgcgatggcggcggaatcacaagatggctgggcgattgtcgcggcggcaggtgagatacaggagtgggcgatgtcggtttgaagctgggcaagatactccttagatgcttccgtgctgtgctcttcgcaacggtctctgcctccgtgtatctcgctccagttgcgcccacatctgcagtgctggggcctcttttaatggagctcagttgctgggtttgaatcgataatgaggcagctcctgcagaatggcgtctgctacggcttgcagcaggtctcggtaatgcgcctgtgctcatcgttgtctctaccaaggctggtgaattggtcgctgttttcttctgcaagcaatcgatttcagcgctttgtccttgttggcgaggatgctgcaatgatgcggtgacaggaggcggcggcggataatatggctggagcttcacagagacaggtgaatcctgtagttgctaatccgaggtgacaaaattcagcaaagaagaaggtgggaggaacacaaaagcaaaaaagagcgggagaatgggatcgagcgttagaaatatgcagatttcagagtgagcaaaaggcatgacacagagagagggggaaggcgcaggggctggtcgtcattggtgtgccgggctacggcgaggacgggccacgattaggcaatgaggtgccgtaacctgatcaaggatgtggtcgaggataggcaggctgccgcgtgtcagccacgctgccagcatcatcatcgctcgcggtgctcgtcccctgccgacaagcagcatacccatcattgatgcgcctagcgttgcctggtcaagaaccactgctggtgttggtcacttctgtgctatcgccaagctaacacacgcacaccactcctgagcttttcatgacccgtcctgtggtccataatcctgtccagttccgctctgcaagtccatgttttttgtccccttgatctcgtgtcgattttgacattgcactgtgattttccgaggggtttgtgagggctgttgtacacttgccaaagatgtgtggttgctattaccgctcctgtacgtgctgaccgtgccttcgaggtttctctggcattctatagcccgcgactctgtcgaccccggcccgggtcctccatgttgtccggcaggctgcataagctcttgaggcctgaactggggcgactgaggactttgtcggttacgagtgtcgcctttggggtttaaacgatttggacccgaagatttgatcgagtgcgctgagttcttgggaccatgatcgccatcgataggcaccttgattagatcccgagaagtgacggcacttgcgcctgacatgggcagggcaggaagtggacggtgagcggtcgctggcgagaacagcgggatttggacgtaagagttggaccgaggccttggttttgtagggtgttgttgggctggaccccctcctgcctccaaagaggcggaagaggtgacgacgtgaagagctggtggggcggattcgcgtttctcggtcctggatgtctgaccgccgttgctggtgctgaatgacgatgagagcatgggtgaagggatggcagcaaacttttcccgggtgctcctgaagaattcgaacgacgtcggcctagtggaggcgttgactggtggaggaggtggtggccactggagagttgtcaggattgtagaagcgcgaggaggagcggacaccccagggaggttcaaggcagcgtcgcggaaaaggaagggaaaaaaaacgattaggcacagtgctggcggacaagggtgtgagttcaacacttcacgctgcttggcccattcttccgtcgtcttcttccggtcgtcgttcctgccgtccttcctggcaggtaaatcggaatataccatggccccaaaggcccatccccagcaagcacaaggccagcttacggaagaaacgaaaatcactatccacaccgactttaccgccatctgacaggactcttgttcgtcgggctcgtgcttgatagttggctcaaacggggatagcagtggatcagacgattcgtgctttcataaccaatgcaaggatggaggtcaagtggagatgacgaatggaatgtgcaatccaaatccctcgccttcaggatagtctttccccccactcgggcggtttgagggcgggttaaacaaaaaaaaagggggtgggcagttgaggtgagtgccgctgagggagctgctgttcctgggcactgaggtacgtgctcctgaaaggcccgaccacgcgacatgatcacatgcgcgtgctcatccatcggcattcaatcaggagccaaggagccatggccctcttgggccacgacatgcacacctgcacaacaaagaacgcgagagcgtgcgcaacagagaagaaagggcagagcgctaaaggtgcgttgaagctgaacacgccaaaacgaaatcgccgtgtgtcccgagcatatgtagatcctccccccttgcgaaaaacactatggcagctccagcaggtcggtaaatgcaagctgccacgggcacagacactgcacacactgaggcccagggcatatttttgtctgtccctggctatgaaggtgctgttgatcttgggtgacagccgtgggtggcaaccgaactctgctctctggatttgtggtacagaaccgcagtgacctcatgaaaggaacatgagggtgcggcaccgaggaatcatccctgctcgtcagaatgtctagaagtgcgtggtgcaaacgataacgagggcatgcaaaagaagtgcgctcttgggctttgtcgcgttcttttttctttttttttttaactctctgcacgcgcagggatcgcggcgtgtgattggcggacacgccagggcagcctcaaaaacgaatcgtcgtgcaaacgtggtccgccctcagatacggtctcccttttgacacttgtgttctctgactcgccgtccttattatgccacggacctaaggaaccgttgcagaaacgtagtttgggctgataaacgaggatcagtcccaggcatcgttgtgctgttcaaagttgacccgccgagacactggcagggtctgattcattctctttgacgttcaccagcctgcatccatggcccagactcaattcatcctcgatcttacattcccgccgtgagtctgccgctgttgacactccaagaaaagagaaaagaaagaaaagaaaatgtaggagaaagtgcttagatgcgctagcaagcttgcatcctacagcgcgtgttgttagaggcacatggtcaccaccaatggtaggaagtcgagataactgctgaaataaatagctcctaggacgagtcaaaaggagttcggcaatcgcctcctcaaaggtactcggcgatgaagccttggtcctcctgagcgatcaccatgggccgcgcaagagtgctttctaaaccatttgtcgcgaagcgcggtgtcaacaaaacacagcttccgaggatgtcccgcgacagtggactgcctggtcaaagttgctctccgcggttcgagccgcactgcccatgggttttgagtttagcccacctgttggcattgcgtttattctgttggctggcggacacttgagtgagtgcgtgtgccagtctcggtcctctgctccccccttcctctgcgccgttgttccttcgtttctctgtgccttcgttcctctccgccctcgtcgtgcgatcctctgctggacaagtgtcttggacgtgcaggggcatcgagcgaggtccttccgtgttgttacaccgagcgaccctgcctgctttttggccctcagcatcacacagttcacactgctcatgtctcctcgctcccctcgttccgctcgactcctttcccccctcctgccttcccttcctgcgctgctctctgacacgcttgaatggccgtgacttcatacacaaaaaccacaaatcctcctcgttggtcttcgccacatgctctctcacttctttgctctcttccactttctttttcgtcctgccatagacactctccaggccctttaatatttgttttttccctgtcgtgtttctggttttatttttatttccagaacgaacccttaaccgcccacaactcttggacttttttcttcaactccttcctcgactctgctccatcctcgtctcttatcctcctgatcctcccgttcttccagctactgcagatcctatccttcacaccctgaccatgagttcctcaagctcgtccagtctgcgctcacctcagcagtacaagtcccactccagcagcgcttacagctcggacgagatacccataacggccccgcaacgaccgcctcgctcaaatcgccagcgatcagagtcaacgtcgtcggcgagcatgtccggtgcccactactatcagcacttccatcaccaccaccagcacaactatctcaaccctcagcaccagcagcagtacgagcaatacatgtcctcctcaccgccgtcactaaaaccgtcccctcgatccacaacaagctcttacgccatgtcgacctactcttcacagccttcttcgcccatgagtttccaactaccgccctcggcactctcttctaccagagaagagccacactttcgaccgggctcggtctcgttccattcatccagcggttacaacgccaagaaccattcgcttatgcacagcaaccctattcaaatcccagccatgtcgtcgacgttatcttccgcaatttcctcctacaggacaccacgcctctcaccggggatcagcggcggcggatctgggggccatttcatgacggcgatgcctcctctcagtctgccggaagcttttctggaggagcaggctgattatgaggaatattactcggatgtaggtattcaggagcagcagcatgcataccagtctacgcccttgcatattcagcactcgattttgcaacagcagagtctggactatccgacctcagccgctttggatcgacacgcacagcagcagccgccgcagcagtccggtggatcgaccttcttgccgtcaccgcatatgacccccaccacgtccccgctctcaggtgactttccttcactaagcctcggtaagtgcgagctaaggggtgatccaggtccaggaagcagggcgtgagggcaggggggctaggatactttatatttcctccggaggcgccatgggatgtgtgtgggcttttcacggtctcaggaatagggtttttttcgattctcttcaaggttcatgcgagctgggacctggtgcggtgggggtagttgcagtgtcctggtggtgcagacgcgcggatggctgctacattgaccaggggcgccgttcgcttagtggagatgggcaggcgggcgtgggctatagaaccgcttctcttgggtatcgccctgtgcgatggagtcgggaaagcgggagaacagcacatgcacaccacatttgacaacacacacgcaaactcaaactgtgtgtatgcgagtcgttgctcagaatcaggaacgtggcatccgccagacacacacgcctgcagctatcgttctctgggcgcaatgcagctatggccatagctacctcagcacgcaacgtgtgtctgtgcagtgcgccttctttattccccttctcgcttttgtttaattcatgcctgtacccttgaaatttgcgctgcttgcgcgtcgtggtgcatgtgtttggacagcatgtgcgacacacacccccatcctatgccgttttgctcaccattctttttcattccactctccctctgtccctctcgcgcgttgccgtcctctttgtgtacagacgactcggtctcttccaggcactcactcccaacgcgcttcaacacggaggctatcctcgccagacccgagggtcactttcgaggacatcctagcgtcccggtcgagtccttcctcatgcctactcaggatcagtaccctcccgactctgtgatcgtctttggtggtacagcctcacactcggagagctctctcttccgaaaggacgccaaagaatacctcttgctgaccaactccagcttgttaaagtacaagtccatggagaaggcttccaaaatcttcggtaaccagtccgcgtggtcttcgtcctcgggccatcagctcttgacaccgcaacagaccagcctcatctccaaggacaaccgactcttggcactcaactcgatcgtgggtgtgcatgcatatcattctgcggggtctgagctccacatccaaatcgaatacctggtttccatctcgtcccaaccgaccttcatgcatttcacaccgccacctgaccaagcagagaagtggctcaaggaactacggcagggatgcaactaccacgcgccacaggcaggactgatccccaaaggaactcggcagcgtcaatgggtgatcgaaaaactccgggacgaccacattgcgcttccacaaagcgtggcagagaacgaccccacagcgctgacggcaggaggcatgtggcgggcctatttcaagagccaaaagatcaaaggggtgccggttcaggaagccgttgccagcgagtccaaagtgcctttggaggggaaggttgttgtgcttgcgatcgggacgtcctttatccacattttgcctcacaatctgggcaacggcagtaccaaagatgacatgaaggatgagcgtctgatcttgcagtatccgatcctcaccacaaaggcgatccagtacaacgaaaaggatgacgtgttctctctgagtttcgggacaacccttcggcagcggcaggtggtcatgacgtttgcttcagcaagggcgcgagagatcatcattgcgatacgggctcgggtcgagagtctgcgctggctgtatccttcgggcaggaaaggaattgaactcttgctctcggaagcgcttgcgaaacccataccggtcccacccaaggactacatgggcgacctgggctacgaagacttgctgcgggcagagtgctacgctatgaacgttgaccgcaaggtttacaacaatgttaagattgagggctccaaaatcaggatcggcaaggttagggatgatctatccgaccattggcgggactattctgtggatgagatgaaatgtctcttgagggcacttcgtttcaacactacgttcaaagagatcagcttccacaacatttcctttgccagtcttcaaaagccccggacgctcaaggacggcaccacgcggtatggactccgtctggacaaggagttttatgagcttgtgatgggcaaccctcagataagggtcctggatctgcacaactgcagtttggatacgagcacgatcggcagcattgggcgcgcacttcgggatggccattctgtggggcttcgacttgagtacttggacctgcatgggaacaatgcctcggatggtgcggacgtgatgactttggcgaaagggattgtcaaacatgccggaacttttcactacttggatgtcagcgactgccagattaccggagacggcatcaaccagatcatgcacgcgttcgtggctaatgctgaagtggcgtcgcacacactcaagacctttgatatcagtggcaattcggagagcaaggtgaattcgtttattctggacattttcttgaagcactcgatccaacttcagcacctgcatctcgctggactgccgtcatggagtaaatcgcctattcttttggccgagacccttggcagttgtggcggcacactgaagacgatggatatgagcgggatggctcttcacccaaccacactggatcagctcctgtcatggattgccagccctgggttccagtcgatgagacaactcaagatggagggttgcgggttggacggcgtccagtttggaaacattttggatgcggtgggacagagtcgcaacatgactgtggaggttcttgcgggccgaaatttgctgtcagacggtaatgacctcccccaaagtttggaggtggtccttgccagtggagacacggcgacgtcgctggggttgcggcagacctgctggagcgaacagtctttgcgacagctctttgtgaatttgagtcagaactggtccctcaagaagctggacctcagctcggtgtcgttggtctcgaaccgcgatccggatgtggagacgtgcgagttgctggggcagatgctgagtgcgaatgcgagtcgactggaggagctgtatattcagggagaggagactgcggatctgacgtcgcggatgggccggaatctgtggcgctcgtttcagggggtgggacagagtcggtacctaaccaagctggatgtgcgccggaaccggttcagggacgagggtgcgcatgcacttgcggaggctctgcgtgtgaaccagagtctgcaatggctggacatggacgaaaacgacgtaagtccctgtggatgactttctcgggggactagagaagtgatttcgaacttgaaccattgtttttgacccaatgctgtttttatatatcttactttaggtcaccttggatggattcaacgccattctgtccgctttccaccagggtggtacggagcatgtgccagcaggaagccgacattacaacagcacgctgtgctattttgaaccacccgttcgggatgtggagaagcaggccgcgggtttgaaagagtcgatgctggagacatacaagacagagcaagagacgcgatttctgttgagcaactctgcaggcaaggactcgagagagtggaaagagcggctggcgcagatcatccggacgaggaacttgagttcggaggcgattgcgaggctggagcgggcgatcaaggggatcgcgcaggcgacggatcggaacaaggcagcgatggatgcggtgtatagggaccgggagcagcgacgcgatcgcgagatggatcgagagcgcagtcggtagtgcacgctgtcgtgtcctggtatacccaataaattacgccgaaatcaaggaacaagaagtttgttgtcacgcgggatggtgttcctgtgcttggattcgcgtagtctacattcgtggctctcccggcaaaccttcgcatcgcgatttggtcaaaaagtatccagatagtattaatgcatagtcgagtcgacgtaaaataaatagaacaacagatctgcattcgtgtacgcatctctctcaccgttgccgtcttcctttttgtgctttttttttgtatgcattttttggtgccatttttgtgtgcctttttttttgagtaattcaggttcaaaagatttcaccaatcgccttctgtcgtttcacctgcgcttcgtcttgtttgtctgctgcccaccaccacagcacgcaccaccgcaccatccaacaaagtccagcaatgacctcgcgggccacgctccggaagcagcaggaggcactgccgtaagtgctgctgcctgccgctgtcgatcgcagccgccatttaacaactcgtgccgaccatgcggctaacatcctgctccccattctcgccctgctctctctgtcgctctctctgtctctctctctctctctctctctctcgctctcttctgcaggatctatgaccaccgccgtggactgatggacgccatcaaggacaacgacatcctcgtcgtcatcggagagaccggctcgggaaagaccacgcagctgccgcggtacatcatcgaagagttcagagacatgcgcataggcgtcacgcagcctcggtacgtgtccgcaatggtcaatgccacggtggacaagcgattgcgaatctttctctctggacccgacagcatactgaccgctgatccttatcgcccgcgcctctccttatagtcgcatcgccgctatctctgttgccaagcgtgtcgcggaagagtacgactgcaggctgggcgacagggtcgggtacacgatccggtttgatgacaacacctcctccaggacacggctaaagtacatgacggatggcgtgctcttgcgcgaggctaccatggatccactcctcaaaaagtacgacctgctcatcatcgacgaagcacacgagcggactgtcgagaccgacgtgctctttggtaacgcggatgatcgccttgatgtcgtccttgtgttcaatctaaatcgacaagttgactgacgatccgtgacttgctgtgcctaatttttccatgtagggctcctcaaaaggacaaaggcgaagcgacccgacttgaagttgctgatcatgagtgctacgctggacgtggaaaagttctcggactttttccatgaatgtcctgtctattcggtgcctggcaggacctatcctgtcgagattctccactctcgcgacaacaccaaattcgggatgctcaaggctggatacgtcgcaaagtcagtcgagacggtgatgcacatcctcaccaaagagaccacatccagggagattggcgacatcctggtctttttgacgggacaacatgagattgagcgagcgtgccaggatctgaaaaaggcagtgctggaaaaggaaaaggaaagcaagaaccagggcagtcaacagtcgccagtcctactgaacgagctccaaatcttgcccttgtatgcgtcgctggaacttttggatcaggccaccatctttggacctgcacctcgtaatacgcgcaaggtcatttttgctaccaatattgctcagaccagtgtcaccattcccaacatccggttcgtggtcgactctggatttgtcaaacaaaagatgtatgactccacgactggcatggatgcactcatggttgtgcccatctccaaggctgcggcgacacagagagcaggtcgcgcaggacgaacacgggcaggcatttgcttccgattgtactcgaaggacgcctttgagcacgatatggagaatgagacagtgccagagatcatgcggacaggactgacgggcacagtgctatcgctcaagaggctagggatcatggatgttcaaggatttgagttcttggacaggcctgggcaagaagagcttatggcggcgctgcgggtactgtacttgatcggagcgattgatcgctttggacggatgacggatattggacacgggatggttgcttacccagtcaacccgctgctggcccgttccctcgtcgaggcagaaaaaatcggctgtttggataaggtcatcacaatcgtggccatgctctctgtaagtcgaacccccccccccccgggctttgttgctttttgtttgtatgtttctttcttgtttgtttgtatgtcagcaaacagtatcggaggtcatggatgacccaaattcacttttaatcccattactttacgccacagatagaggagccgttttatttgccgcgcaaggaagatgagcaggatgctgctcgggaggcacatgcgcagttctatcacccatccggtgatcacctcacacttttgaatacgttcgaggcatggcgagagaccaactactccaaggattggtgccatgagaactatctcaatctaaggcaccttcgattggccagaaacattcgctcacaattgcgggatatcgtggaccgcaattctctgcacgacaaggacgcaaagaggcaagataataaggacccagtgcccctacagctctcaccagaggacaaggacgccagtagccctaaatcagtcggcaaatcttcgccaccccaggcatcactaccaaaggcgccatcatcgcgctcctcatcgtcctcgcggtccattttacaggcattcagtgcagggtatggcgtccacctgtccaagaagcacccccatcgacaaatgttttaccattacttagcgtcgtcgtccacagcaccctcggggagaggcaccgcctcatccagctcattactcgcgctgcacgtctcgccgctctcggcactgtacctggatgaagagcgatccatgacgaagcatgggcggaaggtggcccgagatttggaatggatcttttaccacgaagtcgtgtatcacgtcaaggctgtgatgcggtacgtcagcaagatggacctgcgttgggctcaggagacgctggaccgtgccaggatctatgacgaaggatcagtatggctcaatggcgagcgatccgaatcaccccccgcaaacgaggacggtcgtggcagtagtggcacaggcaacaaacagcaaggaggcggggctgttgacgcggatggcctcagtgcaaagcgaggctccggtcatcaggactctactgcggatgaggcggagacacaggagcaagcaaagaaaagaacaaggctggcattggtggaggctgcgaggcaacgcgccctggaacggcgtcagaatcaataacagccaaaaatatacaacacttatgactgacttggggtcgttttcaatccccagcgactcgcaggccccaggacctcaatccctgattccctgattcagaaactgggctgaaacaggagtgttgccagacgttgaaggcatgccacgggaatcatgcactctatcgctgcttcgtcccaattggcgaagcagacttgttttttttttggcgcgtaaagtgacgagtcgtttgtttatgcatgcgagatgctttagattctgtcgcacagggcagcggaaaatagccgatgaaacagcttctcgggccatcagagtgcatgcagagacggccttactacaacagcaaacagacagcggcataaccgatgaccatgcaggaggggggggagggaaaagccctgctctctcgcgcgcgctctttccctctcccagtctcgttctcgacccccccctgtggcgacgaggcgaaaaaaaagggcacggactttgctgaatgtttggtttactttgtttttttcgcactgcgttgcattgctcagggttccataatcgtgtgtggccagtctcaagatgcccctgataccaactccctccctccccttcgcgcgcccgggatgtttggccgttttcaatcgcaggtgaccacaaacgtcgatccgcctactgtactcgctcttctatgtttttttcctcgatgccgttctggtggaagtaaaggggtagaatggtccaaagaaatcagggatgccaggatgaggttcctcctctacggatgatgggctccctctttgctctttgtttccagctgtcctgggatcaaaaaagagcgagcgagccatcgttgcagttcgacattgactcccttggcttaaggaatagtcttggcctgcttggcaggttgcaacgatctttcaggacaacagcactaaattgaaacgcgagcattctcatcttaaccgagcaatagcccgatcgttgaatgccaacaaagatttcataaaagacatcttagaacaacatgtacggtacattgtgatggaaataagagcgacggaagaaaaagacgatggggtgagaaagagcgatgacctggaattggtactcgttcctttcatattctattccgcaggaacggcctgatgctgtcatggatgggtacacatcttggaagggggctcctgatttccttccatctacccacggttccatgtagctcatacggtcaggatagaatatagtacataagcgacaagtgcaaacgaccgagtgtgcttagagttcaacttgctgggaagtagatgacgcagacgcgtgcagcatttgggctctttgacactactttatcaccccattgccattcgagttcagcacggtaggctagaccaagaacacattacaatgctccttcaggtccacatgtctgctgccctccttttttcatctctgtcttgctgctaccttggatttgcaaagggtccggtgagtagctgctttcttgtcacgttgatcttgaagcagctcgctgcatcgcttccccccccccccttctcttcgccttgacgcacagaattgtttgcttcatcccccttgcctattactgcccttctctgatcctctcgtcctgctttattttttgcatttactggcgtggcaatgaatgacagcaacagcaacgacccaacttgggcatgcaccccagactcgatcgcttatggcccaccccttacacaacacacgttcgccgtttactttagtatttgactgaaggctatgacggcggcagtattgcaaagagcagcctttttcttacagtccacaagtccctttgcgtttgatgaactgtgagtccatttatgcatgcttgtctgctgtcgtcgaccttttctttctcacttcttttttctttcttccactctctccctctcttcctctctctgtcttctgctttttgttttgtagccattcgtcttatttcatgtcaccgttgcccttgaacattttcatttcctctgctttggcagacctcctacatctcgacccctctcctgtgtccttgaccgaacgcggcaatcaattctacagactcttcctccgcccacagtttgattcgccatagctttcatccatcttgacccactctcccactttatcgccaccgctcgctctcgctcgctctctctctctctctctcgaagtacgtatactacttctcttgtagttatatctttttgttccgtcactttgttcctggactggctgggggcgcgcggcctctgctctctttgaaaacgatttgtattatgcttcttgttcaagtacatcacaagaatgacttggagcaccaatacatcccacctcctctgcgttctttgtgcctggacgttggctagaacagcgacaaaagcaatcacacatcgttcatactcactcctcagtgctcacttgggggttgatggggaaaagtgataaagatttgatgccggagacacgacccatatcacggcttttttgctgccgaggttggtccagtctcaaagcgtttttttttttttttacacatcatgatccagtccccttttttctcctgtcatcgttacccgttgatgtaaaattgttcttttcttccccctgcacgtcgtccatcctccttccacctgcttcttcccctttggcgataaatatttcctttgtgtccatcacattttcgcgctgaactgccccttttacttgtccccttcttcttggcctccatctttaagcgcacttctgcttccgcagcggattgtttgaaaaaaagagagcgatagcaaaaaaaaagatgagattcttgttactagcatttcttcaacatccaaacatacctctcaatccgtacaacaaactctcgaaggcgtttttctctctctcacagccgcgccctacattgatcagacttttcttcacctccctgggaatgcaacaaaagacaaaagtgtacgcgcgctttgtgaacaggagtaaggagaaagaatggctacttcatcatacgagctatccctgcttctttttatttcaggaatttggactgcatcatcaagatctcgagatatttttcaagtctttgatcatcaatagcagatgcagagtgcgttatggatgtagagttcacttgaaaccgtttgattttttttctatggggaagggatctcactctagacctgtttgaagggcctcgttgttgacgtaaattaaagacaggcgagctgcatccacgatgcatgggctggtcagagttcttgaatcgtccagcaattcctgaaggagccaacatgagccgggttgacatgcacacttatatttatacatcaggcacatgcaacattacattggcccaccccttggccctctctctcggacgcagcatcctgttcaggcctaggttttgtttgggcgctgctcccccttcttccctcaaaatttttttcaagtcgttgattttatatatactttttttttgttcggtgtttgagagccagcagcgcgtattgtgtttcctctctttttttttgttgacagccccaagaggatgccttgtccctgagagcctaactatgggagcacaagagtggcacttgcttaaaaaacacgaaccctacgttacgctcaaccctcacacagaccgcccgtgcccacggacacacggttgtccacctcagcattgtcctccctgtgccaaaaagactgactactgttcttctcttttcttcctttgccactttttttttacctatcctgtctctcattccattctcgtggcccttctgctcctttaccctatttttttctctctctctctatgcacgcacgtgaagtagacgagcagagacgacaaaaatagacatttcagagaaaggaggaacgagacacgcgcgcgctttcttgttcctgcacctgagtgcctcttcaatttgcattgtttgactcgatcatgaacctatccaatcttttgagcgcaccacctccgggtcaggtctcagctgccatgacagtcgcaccttcatcgaagcatcctagccaccatcctcatcctcctcatcactctcgttctcatcagcagcatcatcagcaatgccaccagcagcagcagcaggtgccgcaagactatgctcatccacagcaacggcaactacaacagtcgcaggagcagctacagcaaggacttgagcatgctggcgactctggctgttacacaaccaagcgcagcaacagtttcagcagacgcatccgtgtcatcagcaacaacagcaacaacagcaacagcagtagcagcagcagccgctaccactactctggtcacgaccagggcagccacccccgcgtcacagccaatcggcagactgagacaggtatgcgagacctggatcgtcctggccgcgccagccctgtggcaggagcgggcgggagccgtgttggctgtggcgaagatgcccgtccaggtaagcaagtgcagtgtcgtgtgccgcgtgtcttggatccattccctgtttctttgtcttgcctgcttttcctttccttcgttcttgcttgcttgcgtgcgtgcgtgcatgctcgtcgtgtgtgcgtgaatgctcgtcatgtttcctatttcattttcatttcattttcattttcattttttttcattctttctttactctctccccactcactctcctctttgctgtcctttgctgccatatctctctccctctctctgtctctcacacctcacactcactcattcttttcgtctcattcttttcctgttctcctctctctgcgtacctacatcacacatcgcatttacacttgcacgtttgcattcgcacacttcacacatcacctctcacacgaccacacccgatctgatctcaactgcacactgcgcactcactctgcacactcgcactgcaacaccgttgcttgactttgacttgacacggctttctataagatacaccgatggccatggttgtccgatcctcttcttcgcaccactcatctggatcctgctctcctatccaactccacaccccgacagacacccatgcagcctcacgcacatccaacggcgatctagctgccagtgtccgcctagactctgccagacacctccgcggccagtctgcatcccaccccgagctcaacccgacccagacatcgtcatcgtctcctccgcatccgcatctgcatcataagcaccgctttgatccgcagaacgatgcatccgcccaatcttctgtcgcacaaactgagcacagcagccgtggccttggccttggctttggccttggctttgggcgtgactatgcaacacacgagagcgagagccatcctgccgccaaggacaatggtaacccatcctcatccacatccacatgttcatcccttgcatgcccgtccatctccatgcattgcacagcttgtcggcaaacaactcaacttgtccacccatccacctgtcaacatgtcaacatgtcaacaattcaccctgagtggaaaggtggggggcgatgcacacttgctggaccacaaggctctcgttcgtttcatgagagcacttgcgcacgcacctggaccacaaaacccttttttgtttctttgaaaaagttctcattgcccactcaaagcacgcttcctgtcgacagttgcaagctgcgatggaggtggcatgcagtgcattgtgcaagcaatgtctccatggatcagttcatcggttggaattcaaatgccatctcactcacccgtctttccttcctttcctttttcctctccttaactctttacaaatatatatgccatcatgttcacaaaaaaaaaaaaaaccaccttgatctaatctttttttttcgcacttcctttctcccaccgtcatacaacatacaacgcatcctttggtgcctcctgtctcctctccttcccctctttcttctctgtccatggttttttgtgtcctcatatccctctcagcatgcatacccatgtccacgccttcctttccctacagcatccttcacagccataattttaatgatagccagagccagagcatgaactcacggcccgcacactcgtatgatcatgcaccggccgacacaggatcaacattcgcctctgaccctggactgcgacgtggttcgaacctgtcgtcgtcgtcggggataaagacagaagaggatcaggaggtgcctactagtacgaggactgcagcagcggcaggggtaacagagcgaggggagcagcagcagagtggcatcatgggggcgactgcatatcatgccagcgatacgcaggcaggaacagcaggatcaggagtagagggggcagcagggacagctagctctagacacccctttccctcttgctctcctctcccatctcgaccagaatcagaataccagcagcagccgcatcctcatcctcatcctcatcatcagcatcatcatcaccaccagcagtaccatcaacaacagcaacagcaacagccacagcaacacctaccgcttcatcaagcaagtcttcctcaacaagaccgaccctctcttccttcctcgcctgctgctgctgctgccgctgctgcctcacaccccactgcgtcagaccccatcgcctcggccaatcagcccttgtcaccatcgccgtcgtccatgaacaccactcttccagcctcctgccaccctggccactcctcgtctctgcatagctaccaccccggccaacctcacatcgcccactccaccaccgccgcaagtccgcacggctctcccttcggccctaccctcaacaacaagcggaggagtcacgccgaccttctctttgtccccatcaaaatcaaggagaagcggaatagctgcgccagcactgccagcggcgcagagccctatcgacccgacgacagtatggaacaccccgtctggcatccgaaggcggcctcgacaggatcgactactgccactactgctgctgctgttgctcagtccagagtgatggcttcatcctcggagcctctgacgacgtcgccctctgtgacgagaaagctttcggtgacgaagggttccggcaaagcggcggcaggcggtgctacgtcctcgccaaagacgttccaatgcacgggctatcctggatgcaacatggtgtttacccgtagcgaacatctagcgagacacgagaggtaagtttatgcaaacagggaccttttttttcttttttggcgcttttgcacagggtctttttgcatcccttgcattgattgccaagtggggggatttttttttttcggtgtgacatcttgggtcaaatcaaccatgaactcacacccactttacacaaacacgcgcccttcttttgtcacccaccattttcccgttgtgttaggaaacacacgggagaaaagccctacaagtgcatcgtgcccaactgccctcgcacctttagtcggtacgacaacatgatccagcacacgcaaacacatggagatcggaccaagagggattcgctttcagcagccacggggtccgcggggggtagtagtaacccgtcccggcctacttctttgcagtcaacacccctcgtcgctggacggccacgcggagggagcagccctggcatgttcggcgccggttatgaagaccctcattttcctcgttcactgcaaggctcacctgcaggcgcatccttcggagccaatccggcgttcgcacagcagcagcagcagccacatcatcatcctcaccatgtctattcaccgtattactcgcatcttcaacaacaacagcagcactcgtcacagtgggcagcaccctcgggcgcacattcctttcaggggacagtgtctggacggcactcgagtattcatagtaatggagattcaaagccgtactttccagtatcctcgggttcatccacgcccgtcattcgaacgttaaaggctaactccagaagcctgcctcatctccagcctcggtcctccccaagcggtggcggtggtggtggtgttccctcggatagtccgggcatgggtccacaccacggggtatcaggcatggagatcgaggagctcaaacgacgcaagagtgagatcttgttgccgtcgtattcgggtgctcggaccacgagcgcttatagccccgggcacgggattggtctgggcatgtcaccgttcacaccagcatcctcccatgcgcattcgttgccgcaggtcgaacggttgacgcctcaggagcaggagcgtttgtatgaacaccgtcggtcagtgctggcggtgcacccgccacggagggacagccgaggaagaatgacgcctccggatttcagtgagctatcgcagggttcgggcagtcgggcgggcagtatcagccagtctcactcgggtcatccacaccccatgtccgcgcaggagaaggagaggttgctggaacatcgcaggtcaacgcccgagttgatgtatgattcgtccaaggcgatgaaacggtccagcaacgatccgaccgacatgatcgtgcagcccttgccctcgcgcgatacccgtacgggcaggcagtggtactcgcaagtgaatacgtccctgccttcgccgttgacgatcaatccacggtcgtcgtccttggctgcacgggagggtcaagcgggtcatggtgggtcgtcattgtcgtcggtggtgtcctctgctggtgaggagggatcgatcgtgttgccaccgattgcaggtagtcctgatgatcatcggcaatcccgtcctcgatcgcattcatcgcatatccaccccttgtcgcggcctgctgagcagtcgggctctgccttgggtgcgtggccacccgcctcgagagagagtgagttcaaggatcggcccatgcgattggatccgacactgtctccgcgactggagcactacttggaggacaggcatttcccgatccgcaaacgcgaggtgctggagtttatcgaacggatggacgcgcgagagtttttcgggctgaagtcgcaggtggcggagacgtatgcgaatgagcagttccggaaccccgagttcttgggtaacatgacggcggtgctctgtgcgatccaggcgcctcacccttcgttgaagcggtcggatcagagacagcgctttgggccgtcgtcgtcttcttcgtcttcttcttcgggtcatcctcgtgcgagcaacggcagtctgaagagtctcagtgatgtgggaagggtctcctcggcgaacgacatggagttggaggaagaggagaagcagcagcagcagcagcagcaagaccgagagagctcgatggacgtggatccttcgcctcatcatgaggggtatgcagaacagtatccacagcagcgggtggtcttggacattgacatggattctttccgacgcgatccagagccggacgttcgaggtctggatgggttgagcatcaagagtctggaacagacgacgagttttgtggcaggattcgagcccgtgatggattacagagagaaggctgatggatcgagagcggcggaggatccgccacggtccgtcagcggatacccgttgaatgccagaatcggtcgattctacctgcccaagtttgcgtatcgtacgcgcgagtccttggtcgcgatccagcagttgcaggaacagcagaggctgagtccgagtggaccgtgggtgtgctgtcagtttgaagagtaccgaggactgtgggtgtgggtgttggagagtgtgctggaaaagtatcacgagatttcgatgcgacacaagatggccttgaccttggtcggggctcgggtctaccatcacacagcgcagtttgtgcaggatgagtgggctcagcagccacaggggcatcagcagcaagatgtggtggaggtccaggaggcggtgctgcagccggaaatgatccaacaggtctggcgggatatgcatcaacagtatcaacagcagcatcaccatcaccatcatcacctttcgcaacaacagcaacatcaccagcaacatcatcagcaacattacactccgcagctgcagcatcggccggcaccacaacagttctcaccccagccgactcatctgccgccacccagcgtccgggcccatcaacggcctttacagccgcttccatcgtccatggtcaaccgggtggcaacatatgaggaataccagaggaatctaacgcctggagacccgcgccggcgagagagtttctcgcagcccggtcctgcggcgaccacgacccagggggcctactacagcgactaccgacagcacccacagtacctgcaccgcgaggacctctcgagcgcgccttcgtcgcctcgatcgccgcatcacgacgactttttcccagaggacaatcaaacgaacgagtcggcttcttcgaccccgcagcaggaggcctcgtccactaccaccaccaccacgactacaacggcgacaggaacgacggcgaatatgagcacgaacaataatatgcaccgccgcatctcgattgcagaactgtgcaaccccatgcagagtctcgcgaccgaacgcgagcgtgaccgattccagcgcgacgatgcccatttcccgtcgtcgtcctcgtctccctcggccaactcgaagcgctcctctatgtagcccaagagatcccctctatttgggtagactcattaatttctgtagagaagagctgtcttcttaatatccattaaaattgttaaacacaagtgtagctttcctctacttcaagaacatctaaggcttcttttttccaaatgtcattttgattcagccaaaacttattctgtgcttccacaaatttgcagaattttttttttctacagcgcaataggttagagtgccaaaatccgttagtgagggcattttgctccttgtgatggtaacagcgatttatcagaaacatgtcaatacaggtgcggacagacattgagtcgcttcccgctattcaaaaaaggcaggatgaggattacacataaagtgagatgcagatcagcgctgttccactttttttttttatgttgctaagcttctaccgttggcagaaagtattctacggtgtcaacacagctcatattcccagggcaagctgagctatctcaaagtcaagcattaaagaaaatgcggcatatatcttggaatccgatctgttgatgtcacgactccgcaacagggaccgaccgccgagagctgttccggctacagtcctgctggtgggtgttctagcgtgtgcggtctatgatccgacggcgtaccttgggctgcggctgctcgtggtggaggaggcggcggttgtgaggatggatcaggcgtttcctggctctcatccgtcgcaccgcggcacacttcttgatgggatggatgagctgatgcgtgctcaaaatcatcacggtgctcatgggaggtctgttcgtgactctgcagcctactatcctggtccatggcgtcccctgcccgatcgtctccttcttcctcctcctcctcctcgtcgtcttcggggtatggatcaaaaatccattctcgctgctcgatcaacgtgtcaacgatgctcgattgtttcccagtgttgatgatactggtcagatcgtcgacctgctgtcggagcaggttgggcgcaaaacaaatagccaggttggccgagtccatcttcgtggtatggtactggtcctgcacccggcccagatgcatcatgaggtactggagtgtgctaaagttgggctctggcaaggagtggacgagagacttgatcgtgtacagtttttcgttgtagtcgtcgatatctattcaaaatcgtgccattagaatgagcggcaaaaaaaaaaaaaaaaaaaaaaagtagtctcgtcagtcaatcttcgtctgacgaacgcgaggagggagagccaatgatcctcatttgcatggcatagctactgctttcttcggcctgcaatttccgacgcccccaagaaacattgtgtgatcttcttacctgcagcggcaataaagctagggtaaaactcaaacagcatgagtggttctcgcagttcgcgaaagtacagtttgaggagcgcagcgatggtgttgatgtccggttccttatcaatcatcctgtccaaatgatcagacccttcgttgaaggcccgtttgatgttctggatcgaacccatatggcccgaaacgcgatagataccggccacggagagaccacgcgcctcaatcgcgtccacgcatagctcaaccaccctgggcactgtccttcctgcctccaccaccaatgatcctccaaatacttgcgagccatctaaaggcgataaagagtaatatatgggatggtcttgtcagtatagccaaacaccggccatcacatcgagccgagatcataacacacggtctgaaaaaagaaaagaaatagacagcacaaagacgcacctgatggagatttgacaagaccttgcttcttgagatccttgtgcttgtacttgtctttgatcttgtatttactcttgtccttctcccgatccttgtccttgtccttttccttttcccgatccttctccttttccttgtccttgtccttggagaaaaagttgcggctcatgttggaaagtttagcctttgctccgtgatgcgatccactacctggagagccgcccatatcctcactgcgttctgttagagtgcccgttgatccatcgtgatccctcttaaatgtagacgtcagatccttgctctggtcacgactgcttttacgcgtcggcactgtaaaagtcggccggctattcgatggcctgtgagaggactcgccgtgcggtgtgttatcgacactgccagtgtggctgctagagacttcgtcctccgctggtaatttgagtcgctcatcctgggcagacttgcgtcttggaacatggatcccatgagccaccatgctacgaattcctcgtgccttgtccatcttgagtggacccttgtgcgttttcgagtccttctcctcaatctttttgttcatctttagacccgatacctcgcccccgctcgctgtttgccgcttcagaagttgaatgagatctagaagaatgtaaaacgatgagtacgatatgtgagtacacgcgcaatctcaaaagaggatgcgtcttagtcctccatcggaggggtgctgacttacatggctcgtccgacccaatgagctcatcggccttgcgactggcaagagatgtttgaatatccttgacccacgccttttcctcacctccaaacgcatcctggagcagtagtcggacgctcgatccaggagtgatgtagaaaaagttcttcttcttggtcatggccagaccattgacgggcaactcaaccgcgaccttctccgcatcaaagcatcccgagggcttcacttgcgtcgcatgcttgattttgttcaacgaatcggccgaggatttcaacgagagcgcgcttttgatgagcccaccttcatcgcggtaaaagagcagaaatcccttgtagatcaccacccagtaatctttccaagagctaatagtcgcattgctggagaccttttgggattttacacggagagatcctttgcgctggatgttttctgccggtaattggttcagctcctacgcacataaaaaattcacaaggaacaaacaagaatgaggcatgcacgattaggtaagccgttcctgcacgatgacctgcccctgcatcgaccagactgatttgtcgttccgagtttttctcaccagcgcgtgaagctcctcctctgataaaccaagaccaagcatttgactatgcagcatgtattcatctgcagatgcttgacgctgaggaaacgccatgggcgcagacggtgacgagtaagactatcaaaagataaagagagaaaaaaagataatttaagtattgcctcgtcatataaattgccataaacattaaattttctcgcaaaggccgggtgtgcgccatgtaccttttctctatcagtagtagatgaagacgggctcgagcccaggtcgtttggagtggactgtggactgccagaatactgtaatgatgctctttggatctctggactggtaggtcggtcccacgttgtctcccctgacgattcattgaaaaagtaaaaggagccatcctcgtctatagacatcatagtgagtaacacgttcgaagaagaaaagcaccggctgagcaaactagagtcatgtctagacttgttgttaccttgggcactgctccagccctctgggagaagatcttcttcggctgtataatcttgatcctggtcatcatgagcagccatatccaggtggtcgctgtgctccgtagggtggccattggcgtgtagatgtgcaatggagggctgtagcggtgcagcagacgaggcgacggcagatgagggcattttccacgatgtctcctgtgtcaacacgttgtagtagtacaatcgtcctttagagtttgtggtgacactccagttcggaggcagcaccacctcttcttcatccgacagtccgttcgtgggctcgggtggaggcgactgtgctattgacgacgacggaagtgcctgaaaagaatccgaaccgagcggtggttcccctggggccacagggtgcccttgagaagactgctgatgcggatgcacatccgcgtcctgaacaccatgagcgctactaccaccggcttcttgggagtgcggcgccgtctctccgtggcgttggtcatgttgttgctggcgaagtttgtggtcgtggtggtgtccatgctcgccttcgtgtgtcccacgtgctgctgtagctcccgcatcgtactcgcctactgcaaggtccagattagtttaggaccgggggacgggtcaactttagtacatggacgggttaaaaggaggtcactttgagaattaaacaaagagacgataccttctagtagccggcagcgatttgcaggaaatacccctgaaagaccattgcactcgcctatcgagagtggaatgagtcttgttttagtcaagctacgaatagcaagcagagtcatgaaggacaagcgttgttgtcttttggtatgcgcgattctcctataacagtaccttcccacctagttaggcaatcggcacgatcagaaggaagagacggatgagcggttatcagacaaacgttggggatgcacgagtgagcataacgccacgatacagttcatgggagccttcatttttttctctcttttttttgcgtccttggtcgctgcaaggccagctgtggtgatgcaaagaagtggcgaggagacacagaacaaaagcaggtggagcaggtggcgaacgtaccattcgtcgtgggcatggtcctgaatcagaatgtggtctcctttacggaacgcctatgagtttgtgtttttttgtttgcagacaccacggggagaggggagttcgatggggtggagggggaaatggcattgcggggttattttcagcttgactcaggaagtgttcttgtttggtgcgagcacggccaaagattgcttccttacgagctcgtcctcgtgcgtggccacgtagtcccattcggcaatggcccactgcatggcggcgacgggggtggtggagacggaagcgcggtggggaggagacgaggcggtgtgagcatgcacgggtggaaggagcgcaaaggtccagagatcagctagggcgaccaatcagcttcgacagcgacggggcacaggcaggacagggcagcaagagtggcgggagaatgagaaaagggcacgaagacgacagcgaagggaaacagggcggaacggggcaggcagaggcgacgacaggcaggtgtgagagaacgagcgtcggggttggagtcgagtgtgagagtgcagtcaacggaggagagtgtgcaaaggagagagggcgagagagagagactcaaaggaagaaaggggacttgccttatgcaccccacagcatatgtcttgacttttcgacgccagtcgttgtcatggatcacagcgacatttttgggggcagcataaggaagcaattgacgcgtacttgtctcatccaccctgtcccagggcgacccatctgttctacctacccacacacgcgacaaggacgcggcaacaaagccggattatctgggcaatggtgcgaggcatgccacgagagagagcagccgcgcggggactgcagtggggtccagagggtctgtcccagtcgatgagtcgagcaggtcagagtcgagcacacactcactgcgcgcagaaaattgcatttgcacgaggcgcactgtaggtttgtgctccacaaaccaggtcagcgcaaacaaatgctcacaagctgcatccactggcccacttctctctccctctctctttctctttcgcactctctccttcacttctcttgtccccatctcacctcttcacaaccattgcactccattgcactccattgctccccattccagttccactcacacatccctgtcaagaacaagctgttccacactctcgccttcctctcccaaccagcgtttcgatatccacatcctcgctgagcgtgacgttccctgcatcgaagctcacttgacagcaaccctcgaaaaaaactatggcaactgccgatctcaaaatcatcatcgcaggctcaggcatcgcaggcttgtccgcagctatcggactcgagctggctgggttcgactacactgtcctggaacaaaccccaactcgagaaccaagcgtcgacgcgggaacagcgacagagctctctactgccgcagatatggccagtctcggcggggctgtccaggtcggtccgacggcccttcacttcttgaaccagctgggcatctatgacgagcttcaaaagatctccaagcccgtgagcggcctctcgatgaacgaacacgacatgaactatgtgggccgcatcgacttgtcggcctatcgggagaggtgagtagggtctgagagcggttaacccctttatttcctaatttcgttgcactaacgtcgacacttcgtgtggcattctcattcatcccgactgggctgcgcatagatacggatatcacacagaggtcatggcacggtcgcagctcagggcactgttgctccagcgcatcccacccaggaggatcgtcaccggcaaggtcctcgggatgatccaggaccaggacagggtcacggtcaggtgctcggacggaacaacacacgaaggagatgttcttatcggagccgatggggcgttcagcaacgtgcgacacgctctcttttgggccctagacgaaaagaagcaacttccaaaggctgatgccgttcaaatggcggtcgatcttcataccatctcgggctgcacgaaaccgctcgatccaaccaaataccctgtgcttttagatgccatgaccgaaattcaatcattacagcttcccgacaagccatatacggtaaggatttgacgatggccctaccaactagtggcactaaacatcaccgagactgactaaggctgcgtccatgtagatatggtttacgcccctactcgataacagcatcgcattcgacatcacgcgagacgcaacaaaaacctttatcaggcaaggagaggcctccaaggtcaatcagtggcggcccgaggacattgaggagactttagaggctgttaaaaccgccgaatgcccctacggcgtgactatgggcgaactactcgaaaacatttcgcatgagaatctatttctgaacatgtcggaggaacgcttctgcgagacctggtatggcggtcgtgttgttcttgtgggcgatggtaagtccatgtactgtatatatcatcacctctgaccgatcattctccaaactttaaaggaatatggagtgactgacatggcactcttgaataccctgtaatgcaaccatttagcctgccacaaggggttctatcagcctgtgagtgaggccatcgctgacgcggtcactctggttaacacgctttcaacaatcacatcaggcaccctagaatgcttaacaaatgcctttaaagactacagggatcagcgggcgccgacagccaaagccgccgttgagcaatgcgggcttttaagacaggtttttacaggaaaggtacgggctgtcaacgcctcacttcatcaaagtcaggacgaatggaatgttgacagtgttaattaacgccaccaactctattatagggtcgagcagcttcgctcaggcggaatgtcgtcttcaactacatgccagaaaaagtacgcaatatgctcgacgataaaagaaacgagattcggcctcagctgcagttcctgcctctcgccaaggacaaaggggctgtcaaaccggcagccagcgcgccatcatcacttcaaacatcaaccactcttggtggatctgaaccagcgcaggacgcgagcagaccaaagtcgtcgatagaatcgacacaggcaccctactcgaaaccgacatcctccacctcgacctcttcagcatcgtctccaagaaactcacggtcatcgtggtcaacgttctcgcggcccgcgttctccatgccttcagcccccactgtacctctttttggctcctcgacaggacttgcttccacactgtcctcgcccaggcaatcgaccatcaagagctctcggctttccatgagccgttcgaaggaggagaaaggttctacaccgcgaagtgtcgatgcggcacagggatctgagcccgcattcatcttggctagtgcagccactgcaactgcagcccctgtgtctccagaggcgacaacagctgcggaatcaaaagcctttcttcaactaggagacgatcacgacagcgcgatctcgtcggacgaggatgaagcagaatttgtaaactgcgattcgagcgacgaactggcaaaggaactctgcctggagggcaaagaatggctcgaggatggcggtgcatcaaggactgcgatagcactgtagaatgatctttcgagggtgagccaactgtgtcaacataaaactcgggccttctcctcgtctgtttctctctgtctatcaatttttctcctctcgtcaatttttttgcaatcagatgtactgtacatgcaaagcacagacatgtctcgccaaacagagacttttgcgacacaagagaatgatcgacaacctcggcatgtagcttcaggagaggtaggggtctcgcccaggctcgcatcgcatgtgaaatgcggccagctagcgggtgacagagtccagaggaccaagggatggctcaccatcagagttggctttcaatttcgttggcacttaggctgggctcctttttttttttattcttttttcgctgtccgagggatgaatgagggccagggccagatcgagctcaaggtcgcattcatgttccagcagctggaacaagggcaccctgtgccgacccgcgggtggaccctggctccagagcgaggccatggccaggattgggcaaggtgcagactgccactctccgtatgtgttgagcacgcgtcgtgccgtgcgcgcgccccacccgccccttgttttgctgcccctccccctgggatgcacagagacacacacgacacagggccacaggggatcgagcaccgcttttgcatttacgcggtgtcatatgcggctgtcatattggcaacaagctcttctttttttactttctacttttctctgtgtctccatctcatcccctcatcccctcatcgcctccgtcttcgtcatcatccccgtcctcgtcctcgcctccttgctttcctcagcccctactgtgcgtcctccactctgtctctgtctctctctctgtctctgtctctctctctgtctctctctctatactgcattgtgtcccctcgtccctcgacatcacctgctgcattctgcattctgcatcctgacccgttttgttggccgctcggccctaatatcacaatcaccactccgccctaggcacgcgtccgtctcctatccatccttccccccctccctcgttgcattggccacattctacttttcttctctgccgcgcctgcctccagcccgccccatccagcctcaatgtcctcgcccgacattgcaaggcctgctccggacccgacacccaagcttaatcagagcgatgccaacggccctccactagacacccctggagacgccctcgttcgctcgccgaaaggaccagctggcgacacagctgccgccaccaagaatacactcgagtcgacaagcaccgagtcggctgccatcatggagccaccccccacaagcacaccgccgcgcaccgccaccagccccaaagaccagaacgagaacggatcgactccagtggcaactgcagccccattagatcgtgtcgacactgcagaggagagcctagataccatcaaggatccggaagcggatgtgaacaccgccacgatgctgcagggcgacgatgccgccgagattgcgtccgacattcaggaacgatcgcagctgagcgtagccagtagtcatgtcacggacctggaccacgagggcgatgctgaccctttggccgatggcactcaggagacggcactggacagcgctgtcattccaacgatgcaggactctgctccagcatccaaggagccaggcacatcgaaaggagctagtgacactgcgattggcaaggatacccaagacaacactgcgctcgcagcagtaggctccacctcggccaacacgcaagcggcatcgactacagcccagccgccctcttccaccttgcgttcagacgaagaacaggcgcaggaagagtcgacgacggaagctgcagcgtcgtacacatcgcccaaccacgagtgggccaggatcctgcaaaaacgacttggcaaaggactcagcgatgcgcagatgctcgcccggtcaaacagcatgctcgcctcccccagcatcctcgcccagtctctgacgcaggtaatccccagtctccaggtcaaggaaaactcggctctttcgccagggtcgtcgaacagagaataccaaactcccgaagagctttttgatcggccagcagccatcgagccatcgacatcgacataccattatgaagacgaaccctctcgggacgactcgttcccctctagcgccttcgccaataactctcagaagccccttctactgtttgcgccgttgaatccggaccaactgtatggaaagtcctccagcacattaccgccaaccgctccaccgccccctgtcgagagcccatcgctcgcaaaggcgtctcaaccccagcccacctcgcaatccaagccaacgtcgcactcagcccaaccccaaccacagccacagccacagccacagccacagccacaccagccgggactcgcccctaccccagttatacccatctccaagaattcgcctctcgcaggaacccaggctgcggtagcgccatcgcctgtcccaaggacgaacttggtatcgccaacgggaaaggaaactcggacatcgccaatgctgtccagggagcaggttttgggcgccaaaaatcctcggcagagtcttgtgttgcaaggggtcgctcaggatgaccggctaggcccgggctcccagaactcggcctcaaggacgctcatggcacatggatcctcctcctctctaaacgcggcaccaacacctcctgcaccagtcggcagcacaccgcagtaccccatcgcccctatacaatatacccctcttacgcagtacaaggctaatccctcgaaagaaggctctaaatccaacaagaagcctcgcgacgccgccgcgccattaaaggagactacgacactggtggactcgcctctgccagtgcaggcggctccagtgcaaatggagccgccgcctcccagcgtggatgtcctcgcggacaaggctaacccccagccacctgtcaccaaaggatcgcctctagacatcacacctcaatgggcactggaagctttatcaggactgtcggacgtcaactttgactcaacactccctgtcagcgctgcagtggcaacgactctggcgacagcttcgaacgtagcgcctgcaaggaccccaatggcgattcctccgatcagtgctggctcaagaggcaacgtctctgcgacggacgcctctcctagggtagccaaagtgattccgtcaccattcgaatcggcgaggattagtattgaggtagagtgatctcgacgctagctgagagcttcttctctatgtttacgcacagctgtaggagatgtcgcgcgatgttttaacacgactctaaacctatgctttttactttttctagacgccaaatcaaaagaatcataatgcggtgccagacatgagatcacagccactgcagccccctgtcggcacggatgtcactcagaactctcaaccccatgttcagcaatcacctgccttgcctttcgccatacccccacatgacaacagcgctcgatatgctggctctcaggattcagttgcacatcgctcgaatcaccccacgcttgagcaacacgctggctcaacgatgcatgcacatggcggccatggatcacatcatgctggccgtagcatctctagtctgcgagatatccagattcaaaacccatctatcgagcgcagcagtttggaagcagcacacctgaggcgaggtggtgagtttttgcgcttaatatgagcaatggttcaatgaggttgcttgtcgccaaacacctggttaactggatctttcacccatttgtagatgcagtctctgcggaaattgcaggtccaaccatatcaccctcggcaccgcccacaaagccgactgtgttaagcctgggctccagttaccagatcccttggctaccccagagcagacccattttgccaccaaaagcagatatcaattcgatcgatgttccggcgctcacgggtaaacagctattgccgacagaaccacggcctctggatctcgactctcgtgaccctgctctgcggttcacgcacctcggggaagcactccggtattggggccaacacacgcccgagggaaatgcgtttgccaatttggatggcaaaggagtcgaatgcggctcgtgggattggtcttttacacttggaagagcagagatgattgccaaagccatccacgacaagactcagctccgggccggcgccagggtagcgctcgtctttagactgtcagagattctggagtttgtcgctgcattctacggcgctattcttgcaggtgtcgtgcctgtgctcgtcaaccagattcaagagttttcagagatggtctacatcatgacgtcggccaaagtggagctggccttgacaacccaggtcaaccacaaatccctccagaaggacttacgcaagggagcagtgtggccaacgggtgtgacctggtggcaaaccgacattctggagacctgggcgcccaaaaataaccagcaggagcgcttacctatcaggaacaccgagcttgcctacatcgagtatacgaaatcagccgctggtgagctcaaaggcgttgccgtcagtcacaaaaacctcatgacacagtgccgaactctctattccacgttcctctggcgcccggcactctatcgagacaagaacggccacgcgcagcccgatccgcagctcgcagctgacccttctgtgccctttacgagagacggcaagagatcgcccaatagtaaaccaatggcaggcactgtgatgacatggctggagcctcgccagcagtctggtcttatgcttgggtgcatcatgggcgtcctctgcggtagctttacggtgtttatggaaagctcaatcacagccatctctgggttatgggcgcattcagttgctgcgtacagaggtatgcatggctgccaaactgctgataggtcatgtgcaatcaggatagcctgctaatgtcctttcgtttgtctcgctgcactttggatagccaacattgcattcacggactataatggcattgaaaagctgctgagaaacttcaggatcaaccctcaggctacagtgaccccaacgcgccctgatcttcgcttcctcaatacggtatacgtggatacccagcgctgtagtccaggattgaaccgagaattcttggacgattacctctatccactgggtatggttcctcagcacgatatttccacctatagtcagtctgcaggaggcatcatgatcaatgcatcgtcaccagaacgcaaaactggaaagtacaggagcgacctcggtgtgattgcatatctcagtctactggagcacggcggaatgatcatctgtactcgggacgctctggatcctccgccagccatcgagaaggttgatctgaggaagcagtacagaaagtccacgctaccggatccgagacgcccgtccgtagatcaaggtaacgacgggaaacccgccggctcgagcacactaaaatccatggaacatcgcttgcagccgccggaagcaactacagcatcgaaggatagtggcgccgattccaaggcacagggtagcctttcaaaccatccagtgtcgtcccttgtcagcggcacctatcttttgcacagaggatccttgcgttcgaatcgcgtcgtagtcctggccactggcgatgaagcaatcgagcgacaggctgagcatgacaccattctggtgggcgcctttggatacccgttagcgcaatgtaagtcaaagtcgaaatgaaaccccaggaacctcaggaatcacctaggatgttggacacattcactaattcatacccctgttgctctggaaacaatgatactatagcaacggcattggtggtcgatccggaaacgttggcgctttcgttgccggagatggtgggagagatctgggtgagctcgccagggatgccagtcggtttctggggcttgccggagcatacacaggatatcttcaatgcgaagccgtatatcgtcacagaagaggcgatgatgccgactctttatcgccctcctggaactgagaggatgcttcgtaccggtctgttgggcaccatcattgagggtcgcatcatcatttttggctcatattgggatcgactgcagcaggacttggccgacccgatgaaggcaattggatcccagtacgagtaccaccatacgtctgatttattggagacgcttttcaacaacattggtggtatcggagtactgtaagtggttgtcatcccacaacttttgctgtcgcgaaaaagctgacggtagctctgatgatctaaccctgtctctctctctctctctccctctctctccctctccctccctctctctctctcatctctgctctcggggactgtagatctatctttgagtgcttcgtcaacaaggagtatctgcccgttgtctgcatcgagctctccaaggaaagcaggtcgagtggtcagcctttaaataccgtggcacagcacgtcgctatcaacgcacgccatgtgctgaaggatgtgaacgcgctaagaagctactgtgtcgctgtctgggatatgaacacattgccccggatattcgacaacggccggcgggtagttgaccacgctctcaccaaaaagatgtttgaattgggacggatcttcaagatcctgtactttgccacctttacggatgacgttttattcaacatcccgagaggggatgatcccacgaatggcttctggagtcgcggtaagttgtgtatgcctttattacgaagtaactataagccgctgaatgaaactcatccgttttgctctctcgggctgtagagtgcatcgcgatgagacagcgccggcaaggagcgacagttcgatatgtacagtatacatccaacatcaccagcccggatgcgtacgacgaaaaaaccaatgtctttatgggaaagttccacagcatcacggacgttttgatctggaggtcaatcatccagcccgacgacgtggcgttcattgagctcgacgctcgtgggaaagagcacaggtcgataccgttcaaaaagttcaaccagaaggttactggatatgccatgcacctggacaagaagtgtggactaaaggcaggcgaccacgttgtattgtggttttctcaggacctggagtatatcgtcacgcttcatgcctgctgggtcctgggcctcatccctatcccattgcctttgccggacaacccccagatgaatcaccttccctcccagctagcgcactttgctggcggtcatacacctggggcatcggcatctggattcagcggaggagtgacgggtgcgggcatcagttcaacgtatgccagtaaccctgcattgacgaacaaggctatcgaggaccgacggaattccattctgaggacactcatgcgtatcatggatgaggtcaaagtgaaggctatactcggcaacatggttacggacgactatctgaagctcaaggcaacaggtactcagctgcgatcctgccgcgctggctttacgcctcagtactctcagacggtggacatctttacgtctgcggatctcgcgctcccgcccttctacaatgtgaccaaggccgccaagacaaagcagattttgggagcgctttctggatatgcacctcgaaaggagtggttcgggtcgagctatccagcggtttaccttattgattctgaggccaaactaggctcgattgcgagccgcaagctgctcatgctcaaccacgagaccctgaacaacctatgcaggaaccaaaagcgtcagttcaacaccactacaggacagcccgtggtgacctgcatgagcctcttcaatggccttgggttcattcaaggctgtcttagcggaatctacaacggtggaccgaccatagttcttcagaccctcgacttttatgccaaccctattatctggctggaggcagtctctcgctacaagggtatgctacttttctttgagttgggtttgcggtccattgcgaccgcactcttgacagagccaacctgaaaggaaagaacacttaggtgatttactttgtctacttgtcttagcccaagatgtagcgctgacctatccgctgctggaccagttgctcatgcgcttggacggttcacatggaccgctgaatcttggctcattgtcactagagtcggtcaagaactttatgatatgcggtcacggaaggactcagcgcgaaaagtacacgactactattgggcgcttaggcccgctcaaaatggagcccgaggcgctaaacttgatctacagccacccgctcaactttatggtgacttctcaggccgagagagccacgacaggacctgttcgtattcatgtttcatctcggcacctccgattcggcatagtgaaagccacctcggagggcgatgatcacactggcgtgtggttggaagacgttggcattgtaagttggaggcatggctatcgcactctagggggggggggggggggttaccatgtttttcacagcggctattaacgaatttcttttgctttgctttctacgcctgtagtcgactgtatgcacatcgattgccattgttcaccctgagacgttcgaggtgtgtgcagcgaaccagattggtgagatttgggtctgttcggactcgagtgcaaactcgttctatctcccaccaggttatgttgtcaccaacccaggtcacccacagccgtttggtgcgtgcatcgccggttatgacaatcgggtgcgctacgtgcggacgggagatttgggctttttgtggaatagtcagcagcagcagctcatgaatcaaccgcagtggagtaatggacctaacgcgcagactgcggctcaaacgaacgcgcatgcgacctcgggatcgttccagctctttgtcttggggagcatggaggaatccttccagatgcacggattactgcatttcgcagtggacgtcgagacgactgtggagggctctcacgccaacgtggcgccgcagggttgtctgacgttcaagacaccgcagggtcaggttgtgtgtgtggtcaaggtcctgaatcaggagccagaggtcctggtttcgatgtacattcccatcatgcacgcgattttggagcaacaccaattcttgcccgatacgattgtgttggtgggtgagactgtgtctacggcacgccgagtcgctgatggactgaagccccgggaggcgattagcgggttgtacacgtcggagcgactacccatccttcacctgcaccactgtcacggaaaggccttagcgccggttccaaagtcgctcttgcctcctatgcatgagcgtggtgtgtcctccgagtcagcattggccacgccccctggctctagaggggcgaattatcagcttcaaactctgcacccacccatgtcatctgtcggaggaagtagccacaccaatggaggtcgaatgatgtccggtattagccctgcgcccatcatgacgacaccaagtaacagcaacaacagtcgcgcaggattcaactacaataacaacaatagcaacagtgttagcaacaatctcaacagcggcacgatcttgatctcgggcgatctgccagggttcagtgcagccaacaatcccaaccgcagcagtctgtacggatcgccgttgcttgtggccaacattcccttgccgcctggaaccaccaacccgcttattcagtcgcccatgtcgggtgcaggttaccagccccagacccattaccaaccgggagccaacagcttgaacgcgtttcctgtgctgccttcagcgtctggagcggtggtcgcttcagcagcagccgctcatccgagacccatgtcccagcaagcgtttgtgggccaccatagccctgcacctcttcacagcgtctctgttgcgggatccaacggagcgggaccttctgctgcaggtggtggtggtggtggtagtggcagcggcagcggcagcgcgacgagtgcgtctgtggcacagagtttggcgaacgagatggcgatgtggggaggcgatcggtcgcgagggccgcggttggcgcagcagcagcatagtcagccgcatttgcatcagggagcaacagcagcatcaggtggaggaggaggaggacagcagagaccggctcatacacgacagctgctggggcaggacgggaggtcgttgtcggccgaggagttgacgcgtggtggtggggtcaaggggatcatgaaggggatgaatgcaaagtggacggagatgcggaaaacgggtctgaattgagaaggaggagggaaaaaaacggcggtttttcttgatttatgttgttcctattgtcgcccttgtaagaataaaaacacgcgttgtctgtaccatctgcttttttttatctgctgcactttgctatgctatggagcattctgatgattgtgatacaagatcgtgtatgagatttagaaaagggggcagagaagtgaattttgcgggactgtacgagagaaggagtgcttttgactttttgcctatttagaagtcgttttctgtagtctttgagcgtggcgatgatgctgccctcacgcatagtacctgttcgtgcgagaagacgggcagaatcaagagaagtgataatcaagataaagtccgcacatagtcgaaaagtatatctgggccaagatggtacgagaaaaaaggcaagcacaatatgaaagagagagcagatgagcaagtggaggaagtgcaggagtgagatgggtggggcgaggaaagataggaatggaagaatggaagagaataacacacaagttatgagctgcatgggatgtggagcaggactgatccgtggccaacattcgccatgtccgagagataaaataagctgcacgccaatggcagtccaggaagaagaacacggtcttcttttgcagatgctcatccagagagagagagagagtgtgtgtgtgtgtatgaatggtgctgaacgtcaacagcctcgcgcttcatgagcctatcgtgttcccaaggtcatacatatcaactgaaaatgtccagctgcttcctcactcctgtttctttttctgaccataatgcactcaccccaccgccacctttcgctgggctgatatcgcacagcgcacaatgagccagcattactcattttgctactcagtcctcgtcctctcttttctctcttcctcactccatccatccactcctattcctgcttcactgccttcatgttcctctatctcccgttccgtctgctttttttggcaccattttggcatcattttggctcggacgagtctccgataaagaggccagactccacagtctctttacaaactcttcacaagcatgtgcaaaactactttgcccccctgttttttcctaggctctctttctctgtccagcatgacgatgtttgttcgggatcgacgattttattggtgcaagggttgcacaaggtcttttcatctacaccgtttgcagcgtcggtcttcactccccgacgctttcgtcgctgaacaaacggaaagagaaagcagtgtgtgcacacgggcacactcattcggcaggtcctctcgctgaccagatgtttcgaaggacgtaaagaaccatcgaacactcgttattccacgtccaccgagtgggttcgtataaagatttctcattttctgcaatatataatttctgtctgtctctgagttcttttgttccctcgtttttcttttcctccacgctctccaagtccagatgcaggcggctctggtaagtccttttctcgtcattgtgctagtcatcctcataaccaccagtaccaccagtaccaccactaccacctcctcctcctcctcctcctcctcctcctcctcctcctcctcgtcctggccctgctgctcctgttcacactcgagtcagcacacaccacagttcccttgctgtcttctcagctaccttcacacgctttccagagcaccagcagcagctgcggcaccagacaccagagttctcctcgggctgcccccacctcttgacactctaggcagacccgccacaaccactccagtcgcaacctcttgactcccttgatcccaaagactacactcgacctgtcttttgccgcggtgttttgcgtcagtgtcagtacccacgttaacactttctaaccccagcaccccacctctctctctccctccttgctgtgcaccacctcgataggcaatggagtgagccactctaaaaaacgcagtgaaggctagcactctaaccaccacggaacctgagcgagttcgccgccgctatagaaaccggagagggcaggaggacaagcacctctctaaaaaatacaacgggctgtcccgactggcagtcggttctttttacaccaagggggagagtggagtgacccactttaaaaaaactcagtgaaggctagcactctaaccaccacggaaacttcagcgagttcgccgccgctttaaaccggagagggcaggaggagagaccctctctaaaaaactcaacgtgctgaccagtcggcagcatgttcaaggagggtagggcgggatgttgagagagcagtggagaggaaaggagaccccccccccccacccaacaacgtaagtgcatttctttcctaccttgccttgatttgtgtgcccatacgctatgatgtatcgtcgtttctgttatcatgaacagcctactaacactttattctgcggccgaggttgggggggggccagcctctcttgacctcggccgccctggggcgcgatccagaccacgtcctcgtcgtgcgccctggacaccttggtgacttttagagtcgtcagggtgacagagagtctggtttagaagaatatttattatgaataaaaaatgtgagaagataataagagccgtgctcgaagaaaaggaggcagggtcataggacttaagtgtgtgcagggtgaatgagtgaaaggcagagtgggttcccggcacactgttggcacgctatgttcatagtcaaaaggagggtcatggtgagaacacgcatagggcctggattgacaggagtgacgctgagagtacgccctgtgcctctgtcatcaccgtcttcgttatctcgctccggaatggggtccggcagtagcttcaagatgtgacagtttcagtacggtaggaccgtaggacggtggctcagcagtgctacgtgatgtcgaaacttgaaggggtgagaaggggtgaggagctgtgtgagcacaagggaacgcgttgcactgcagcgcgcagtcggcgcgatttatcgagtacacgagcatgcagatggttatagtatgggactggtgttatacgagatgttcatgcacacaatccttagaactcaatgctcatggtacactagagggacgaaaggcgaagcttgagattttgtgccgctcccacgctctttcatattttttcgtaccttgttccttcccctctcgccatcccatcttttgttctctccaccgatatactcatacccttagctggctaccccatattgtcacagcgaattgagagaagtgtcgatttttcactccttccttgcaagatatatcctccttcgcagctgtctctcacttcaacaaagcgcgatcctcggaattatccctcaggtgcgatacgcctcttttcttgatggaggtgcgaagcatggagggggtatagttgcatggtgtctaacatcacagatctacaggtgtctgtcagttttgaggcggatcaagtcagccagcagaagcgtgatcgggttacatcgcatcattgacaagtaaggacctgcagtgcctaaggacgaaactgagagcggtgctgttgagcagcaagtgcttcatggccatgaacagtatgctaacccacacatgatgctacacacctcgctgcgacttgatcgcctttcactaccaggaagttgaaaggtcatccatagcgacattattcctgagtcgtctcagaccaaggatcctcacatcgctctcggagaacgctctctcgcttgcctctcttcaggtatcacaaggcccatgaacacataccattgatcctgccgcggatactttgtacagctgctaaaaatgctgttgcatttactttatgaatgctttagtgctaccgccctgaagcctcattgggtctttcgttgccggcctccttatcctcggtgtggtaccttcgaatttgccaaaggtaagagcagcgcgtggcattgcgcttcactttgttgcattcggtcaaggcaagcgctaaccgcacactttttaaatacttctatacagtatctaggcacaactataatgagtaacccacccaacacttcaccacccgacatcgggggatccaccaatcgatcgctggcgccgtcattgaccacccatgagcgatctgtcagccagggctcagcaacgctctcatctcagcaagtcagcttgaattccgagggcgacaatcagtccatttcgtctcagaaacctagaaagcgggacaagtttttgaatttcgtttggccagctaaaactaaagataaggtcaagatgcaaggtgctccggccgagacaaagatccatcacgatggcgctgctagcaccgatattgcctctgccgtctccagcctcaggatcagcagctcagagactgcatcacagttcacggtctgcgagagtgacgctcgcctcaaggcttccttggagaacgcgagcagaatgtccattggggtcactctgcccagtctcgacgcgcgcatcgaatcgacatctcagctcgccttgtgcatcaccctccttccaaaaaacacagtgtcttccttgcagactgaagacctcgggactgcttacgatctcacaaacaaggtctcgtggaccgcgtcttctaatggtgcagagcaggagtggatcaaagctattaaagggcacccaatcaaacaagaacacctccgctggctgggatcacgcattgtcgaggaattcatcaagcatgctgtcaaggactcggttgctgtgtctgaggtcgtactcctcggccctgtcattgataaagcgctctaccacaagctgctcaattgcttcattgaggagctcaacaaggccgtacttttggatgctgatctgctccagggtctcgtccagctggttcagtgctcttcgccgacgtatctgagcgccgatgatcttgtcaagatcttgagcatcctgagagtacgattgattgagacccatcagcagtcgtcagagcatctgtaccatttgaccttggccgtctctcgccttcttgatgtcatgggtgaaccagcgcaccaagtcaaagacctatctcgcgttgaggaacgagagccattggccaaggctctctctggactgcaaggcagctcggacccatatctcatgtaccaagcactctacgcgttccaggctctgcagtacgtaccagacgacgaatctacccttcaagctgtcatgcgatactctctaggcgcggcagagggcctcatcaaggtctcgggagtcattcaactgaactgtgaaggactgctcgaaggtctcaagcagatgcaaaagacggtcgaggagacatatgggatcgccaagtccagctacgaaggcgtcagctctttgatcgacagtggacgtggactatttgacagtctgagaattgggcttgcatctggccgcaagcatccgtggtatcctgctgtacttgccgctgcagcactctgccgagcaggccaactgaaggactttagtcaactggtgcgagaggtgccatgccgtcgtgacccgagattccagtggggtgtctgtcaactcctaggcgagaccgcgctcaatcaagaatgggtgctcagtgtccgggagcagtctgtcactttcctaggagatctctgcctgaatgacgccgactggggtcaggacgacagtgtcaagtcctggacgctgacgatcctccgcaagatctcagaggtgcctgatcgtacggtcagagacctggctcttacttttctgcagaaagcaacaaaggatggctctaccactgtcgcacatccctatcctttaagatctcatctccccatcccaggatcatcgccgcttctggccatagtccaggaaataccctacgtcgagtacgatctcgacaaactccggtctcagcgattgaaggactacagtcaaaccgtgtatatccctcctcaagccaaggccaccctccaggcttctgacgaggaggctgtagcgcttatgcaaaaggtcaaggagttcatgaagagcgaggggcaggtgttcttggtactgggcgactcaggagcaggaaaatcgacattcaaccgatatcttgagcacgagctctggcatgcatacaagccgggcgacctcataccgctattcatcaacctgcctgccgtgaccgaaaactatcggaacatcattgacgagcagttgcgcatctacgaattcccagaggccaagaccaaagagctgaaggagaatcgaaagatgatcctgatatgcgatggctacgatgaaactcaactcaatgtcaacctacactctgagaacctgcttaaccgaaagggacaagtagacatcaagatgatcatcagctgcaggagcacctatcttggaaaggactaccgcgaccagttctgtccacaacaaagcgatcgatacagtgccactgctgcaaatgtttataccgaggccgccatcgtacccttctcgagtgaccagattgaggactacgttgatcagtttgtgcgagatccagaggtacacaagctgattggtgaaggacccatctggagcactgaggactacatggacaagctgcggtcgattcccaacttgatggagctggttaagaacccctttctcctctctttgtcgctgagagcgctgcctggagtggtcaaggacggaacagatgtcgccaagatcaaggtgactcgtctgagtctctacaactccttcgtcgagcagtggctggacatcagcaaacgacggttaaggacgatcaaactctcagcacaggcagacagtgcacgtgcacggcaggaattactcgaggactttgccacgatcgccattgaatttttaagaaatctcgcggctgccatattcagggaacaggacggaaatccggttgtccagtacacacagagaggcgacaaagggacgtggaaagttgagttcttcggttcgaaacctgataccacactcctccgagagtcctgtccactgtcgcgttcaggtatccagtaccggttcctccaccgctcgttgttagaatacttttgctctctacatatctacgagacgagtgagactacagacgtgctttcaagtgttgctggggtccttgccaagcgcccgctcagtcaaaggacttttgtaaacgagccatcgatcgtcgagtttcttgcagagcacgtccaggacaattctgatttccgacaacaacttcaacagataatcgagcggtcaaaaaccgatgttatggccagcaagcagcagccaatgccatcaccgtcttggtgcgggccggtgtgtcattcaatggagccgacctctcagctattaaaattcctggcgcggacctgagtggtggacagtttgattcagttcaactacaaggagcagatttgagaaacaccaacctgcgcaatatctggctgcgtcaggctgacttgagcaacgtgcagatggaggacgtccgatttggcgaatacccttacctcgaggaagacagtagggtgctttcgtgcgcatactctccggacgggaagacgcttgctctgggccttgggggaggcacgattagcttgtacgacacggcaacgtgggagaagacacgcacattgagcggccacaccaaccgtgttagaactgtggtgttctcgccaagcagcctacagatcgcttcgggcagtgacgacaagacggtgcgactctgggacgcacaaaccggtacacctggtaccatccttgtcggccacaccggcagtgtgtatagcgttgcattttcgccctctggccggcagattgcctcgggcagtgacgacagtacggtgcggctcttggacgcacaaactggcatacttgataccatcctcagtggccacaccagctatgtttacagcgtggtgttttcaccaagcggccagcagcttgcctcgggcagtgacgacatgacggtgcggctctgggatgcgcacaccggtgcgcctggtgccattctcaggggccacaccgatgatgtcaactgcgtagtattttcgccaagctgccagcagataggctcatgtagtctcgacaacacagtgcgtctctgggacgcacaaaccggtacacctggtgccatccttgtcggccacaccagctatgtgtatagcgttgcattttcgccctccggccggcagattgcctcgggcagtgacgacagtacggtgcggctttgggatgcacaatccggtgcacttggtgccatcctcagcggccacaccagctctattcaaagcgtggtgttttcgccaaatggtcaacagattgcctcgggcagtgacgaccatacggtgcggctctgggacgctcaaaccagtgcgcctggtaccattctcaggggccacaccgatgatgtcaactgcgtggtattttcgccaagctgtcagcagatcgcctcgggcagtgacgacaagacgctgcgactctgggacgcccaaaccggtatacctggtgccatccttgtcggccacaccagctatgtgtacagcgttgcattttcgccctccggccggcagattgcctcgggcggcaaagacacgacggtgcggctttgggacgcacaatccggtgcacctgatgccatcctcagcggccacaccaacactattcaaagcgtggtgttttcgccaagcggccagcagattgcctcgggcagtgaagacaatacggtgcggctctgggatgcacaatccggtgcacctggtgccatcctcagcggccacaccggctatgttttctacgtggtgttttcaccaagcggccagcagattgcctcgagcagttccgacggcactttgcgcctgtgggacgtacaaaccggcgaacctggtgccgttctcagaggccacgccgactgggttagaagtgtgatattctcgccaaccggcgaacagcttgcctcaggcggcgacgactacatggtgcggctgtgggatgtcaaatccggtttttgtttggctaccatagagggcttccatggatggatcctgtcaatcgcatggaaggctagcgtaggtggcagctacttatcgaccggttgcgccgatgcttccgttcgtgtgtggaaggtggaagaggcctctcggcccgtgtctgtgcacctaatctggagctcaaggcgtgatcagtttgttgtatctggtgccaaaattctgagcgcgcagggtctgagcagtacaaataggaaactcttggaacagcgaggcgccctcggggaaccaccgatttctttggaagagcccgaagttgtagatgatcattcaataccatgagatccacagtccgaaataaaatgccctgaatagcatgtcgcgtggacctgaagtgaagaaaatccattgcaaccctagggtgatggagatgtattaccctgtatctgtctgatatacaaattcgaaatgaggatgcccaagtttcccttggaaagatcactttgcaagcaatttctgcccatcaatctttcattttccctaccgaaatcccccacacgcgttttgaacaaaaaaaaaaatgttggtaaagtatagtggtttgatactgcgtcttcccattgtcctcctctataaaaaacgccgtgtcattcagacaagacaccccgcaattctcgcaaaaaaagcacaactgacaaaaaacaactgccaccatgaagctgcatgccatcttcctcagcgttacgacactttgcatcaccgctatgagtgccagctctgcagctgccaccatccgtgaagtcacagacgcgtccttccaagccgcggttctgaactcggacggcacgacgctggtacgattctacacgccgtggtgctctcactgccagaacatggcccctgtggtccaggcgtttgcgcaccagcatcagcaccagatcacggttgtgcaagtcaatatcgacgcgaatccgcgcaccacattgcaatacggggtgacgtccgttcccacgacggcagtcttccgtcaaggtcaattgatcgacaagattgcaggggagatggatgaggaggaactagagcaggcttcgcttcactggatgtgatgaacataggtgtcctctggctgttttcttttttgacgataccgtttcggagagcaagtaataaaaaaaaaatgacgagagacattcttcttggctagtttttaatctcagtgtgggtacaaggctatgatacatgagacgtggaacaacaaacgcagtgcctactacatctcttctctgcgactatgcgcaaacagaaaatgaatgcaaaagaggtgtgcactttgaggggctcaccactcgcaaacacctcctccaagacatcctcccgagcagacattcgtctcgcgctcactcgtcgaggtcgtctctgtgatcgaccccgactcgtccaccgtatgcgtgaccaacgtgactggcgccaggtaggacgaagaagacgaggcagacgcggaggaaacagaggacaaggaccgcgtcagccggccgcctatactagtactggcgacgcgtctctggcgaccaatcacaggccagtatgtctgaccgcccttgcacaccctcatcccctgagacacaggcgagggcaacaacgaggacaatggcgactctggttcctcctcctggttcatgctcatactcctcctccgagacccccgtaaactttgaggcatcgtcagcacaggtggcaagtgtcctgtccgtgctccaggcgtgagcgaaggcgtagacggacttgtcatcgcaccggcaccacgggcagtggcagcctcttcttcggcctcgagttgttcgccagcagtcttccagcacgctgccgaacagaaccgcaccctccgagccaccgccgggtgacccaggtaggacttgacacgaacagagctcacccattctttgacatagggccgtcgacagagaccgcaggggcgcgcgccaggctgaagatagtccaccacctgctcaggcatgtattcgagtggcaagggctgtccgcggtgaagcacagctcgggcggccagttccaagagcgaaggaaagaagacgggcgacgacgttgtcgttggaagcacaagtccattgcgaggggttgtcgagggcatgatgctggatgactcggaaatgtggttgttgtggtaatgcgatctaacaacgctgtagctctgggcttcctggggcgattgcacctcgggcgacggggtagccatcacgggtgtggaaggggccgagaatgacgtgccttcaaagatggagggctctagtatcgtgaatgcggatgatattgtggtggtggtagtggtggtggtattggatcggctggggagagacgggaggtggtcaaagaaggaatcaatgtccgaaatgactgcctcaacattgacccggggtgtggaggctcctgtggcgctgccgtaggggtccgcccaggatccgccgtaagcactgccatagtcgcttgctgaacctccattctcattcagactgctgacagactctgctcgcgagggcggtctagacgacagagcatggcgggtataatacaaatgatagtccagcctctcatcctgatccatctcgtagccatgctctcctgctgcggcacttatccgaggtgactctcgtccgccctgcaggttggaaagagtcggggtgtggctgctggaggatgacgaggtcgctgcggaattcaaaatggcccttctcgacagactcctgaggacggccgcatagcgatcatcgtcagctggataattgattcccaggccaccaatgtcgctccttgggttcctgctcgcgtcgcagtagcctcgtgtgaaaggatttcccgttagcaaaagtgttgtctttgtcaagaaatcggccacgtcgccaggaatgacacagagcagattttcgctcaagtcaagggtatccagttgcttcaggtcggcgatttcagtcggcaagctagtgagctggttccgtcccaggttcagactgcgaagttctcgacactgtccaatagactttgggatcgcctccagtttgttgtccgaggctactagctggcgcaggtgcgactgcggatgaccaatgtctgtcggcaggaagcacagcttgttgtggctgagatcgagttctcgcaacgcgctcatgaactgtatacatcgggctgggaaagttgtgaggagattgcctccgtagacggaccccatggaaagcgactcgagcttgtctagacgcgcgagtgtatgtggcaaggaagtgatctggttcgcacagagtcgcagagtcttgagctgagtgaggctcgagcagatctggatgggaacaggtccctctatccgattctgggacatgatgagcacctgcaggcgggtgagccggcagagctccagcgggatttctgaaaactgattgtgggagagattgaggtatatcaaagatgggaatagtgaggtgatgttggcgggcaaggttgagagccgattacgcgataggtccaattcagtgagatggagcagcggcgactgcaggatcagcagtgtgtgtggatccagtgtgggctgcagattctgaaggtagcgttcgagttgctcgcagtcaagtcgcctccggcgaaggatcaaggacgtgacaggtgcgtgtgcttcgcgctcttgttgctggataaaggtcgcgggtgaagacggacctacaacgttgatgtcaatatgatccttgtccacctgcctgggggatcgcctcttgttgacgtggcggccgagcggagccaggactgggttgtcgatgcaggactcgatatccatcaagtcatcccctccggccttgacgcccgtgttgaacatgggattcggtttggccatcagcgagctcgagaaggacgtggaagccgacattctcctcgagggcgatccaggtcgtgccagtgggaggggcgatttggacgagtggggagcaggcggcggtggtgggggaggggatgagggtgagtcgctgttggcgctggtatctaggtgcagtcgatccgagaaggcgtttgcgagcatcttggtcgtatggctcgtatggctcgcatggctcgtgttacccgtgttgctcgcgttgccagtgttgctcgcgctactcgtgttgtggataatgtccgtgctgctggtgctgtcgcggaatgtgtgagactgtgtccgctttgggacgtgcatggctgctgagtaatcacggggcgcaagggcagcaggggagggcgccgggtgtgggcggagtgcgtgggtgtgatgcgctgtatccacaacggggtgcatgcgttgagagcgagagcgagggtgtggatgctgcctttgcgagggcgaaggagggccgagcggggaaggaggaagaggaggagggggtggaggatggccctgtacactcatgagtgtgcctcgcacggaggactggcaggcgaaggtgctttcttgctgtatcgacagcctggctggagcgaaagggaaaaggtgccgttggtatcgtcactatcgcatgtgtcgcggaaaggacgcttctaggccccaaaggtcctttttggttgctcttgttgggtctgttgggtggggacacaaggaacaaaggcaggtgtcagtaggagtgtcgatagccacacccgcacagcaatgaagcatcaaggcatgcacaaggtatgcgatgcagtgctagggcctgaggtgaacgcacctgatcagattacggaacaaaagagagggttgtgttgtttcgacaatgcagacaatgcaccgttgaggtgatgagggatcaggcgtcggagcggggtgcgtgagagagtgcacgggaagagatcaggggtgtgcgtgtgtgtgtgtgcgtttgtctgtgcagagtggagagaaagaaaagagagaaggtgagagcgaaggtggaggtgcaacgagaagagcgacgagtgcggtggagtgtgatgacaagagagagagagagagagagagagaaagtggatgcagcagtggatgtgattgagagagtgaaaaaaaaaaaaagtgatgggcccgtttgtgtctgtctgtctgttctgttcttgtctgtcgtgtgtgtgtggtgtgtctgacacactttcgtccatcagataaagttgcgggccaccaaaaaaaaatttatctgatcggtggctttcgggaccgcgagggtacgagggtacgggtcttgtcaattatgaaaatattttaagtgaacagatgcgaatacatctaactgaccaagcgcgtccccaccgtgatcagctgtagagcttctccttctcgcccctgttgatcgtgatccactcgcactcccgcgctcgttgctcgctctcgttcttggaatctggtctctgcctgttgtctcctcgcaaaacaacttgtcttctcgacgatctccgttccatcaggatcttcgcatcagctagccatccaggcactcctctagcctcgcgctctccacaacttggccaacgtcccaaccgcattgaccaccatggctgcaaacactgatctcgacaagaagttgcggcccatctacggtacgctcgtcacaacagcaccgccttaccacagacaccactggaacgaagcattcgaacaggcacgatccagcatgcggacactaacagacaaaaggtgtctacttcccttcatcgaccatttgcagatgccatggaggtcggcaactacaaggagggtattctgctctgcaacaaggctttaaagaaacagcccgacctgcatatcgtcaaggtatgccccactcatcagcaaggatctctggatgacgtttttttttgtttcggcgttcaaggatccatcgcatgcaccagtgcctttggacccgaccgctgactacatcttgattcgatccggttcaacggaacttcaccctctatgtaggccctgaaagcactggcctttgaacgctgcgggaggatgaacgacgctttgctcttgtgcaaggagatccagtttgcaagaccaacagacgagccaaccttgaggaccctatccatggtctacagatccgccagcaaatgtaagctggaagccctttgtgaatagagagtcttcatgctgcatagtgaacatgcacagctcgggggttcagacctgacacatcgactcaaaaaccacaccatctctctcttgcttccgtagatgaggaaatgatcaagctgtacgagcatgcttccaaagtgaaccccaagaacgaaaacttggcaacccaatggttcatgtctcttgcacgcgttctggactacaagggtcagcagatggtacgtgctctctacagcgcagcgcagaaggatcatgacacacatgggaacatcgactcgcaggagctgtaccaacactatacccacacactgtctgaaatcaacctaggttgctctccagcttcacaagaactttaaaaagtccaaccatatgttctgggccatcatgagcatcacgcttcaggtatgtgtgggacactgttgcactcagagaaaaggcctgatcagtcgctcaagtcactaaatcaccttgtttgaacaatgtcatagggtcaaaatgtccctgctagccaacctaacctcttctatccattagcggagcgcatgatggccaagttgaacaccgagggcaaggttcagacaatcgaaggtaaccattgcgcttgattctacaagaacaacactttgcagcaccttggaaccttgtcaacttaccttgagctgtctcacgcctctcgtcttagagctccagctgtacctgatcattctgctcggacaaaaagaccgccacgcggatgcgctcgcacttttggagggagaaatcggcaccaaaaccaaagccgtcgagaacgttgagctccgtcacatgcgtattgagctacttatcaaaacaggacgctggaaggacgccagggatgctgcgacgcagattctcaaagagatcaagtacgcacactgcctatcgaatagccgaccacgatgctgccatagacctcgcatcacggagatactaacaggatcaatggccacttgctgtactgcatagctcggatgactggagaacgattctccagtattttgacacaatcttccttcccgtcgcggatgcagacttgaagacatctgagaaccttgctgaagcacgtgcattcacttccgagctcgtctcaagcgagggcaaaaaccctaagcgaggccccttccttgcacagattgaacttgagaagcgtgtgcaggaaaagattggtgagttttgtctactacctttctgctaccagagtcgtgatagctgaaccaactcaactcatatatctttttcattttgtttccttgaatgtccgcaggagaaaacaaggagaaggtgctggacctgttgatgggatattttgacaaatttggatccaagacatgctgctttgaagacctctccacttacatctcggagctggaaaaggacgacgctatgaccttttgccggaatctgaaggaaaagtacggcgagaaggctgaaacggtcaaggaaatctgcatccagatcaatatcgtccgattcgagcgattcacggggatgcacgccaaactcaactctacagagacaatggcgctcgtcaaccagttttggaagcgctacgaggatgctctaccactcggtaagtacatgagacaagagagacacctgtggacatggtgaaggaagagaagtatgggtatgtggtactaacacacggctcaaacccatatcataggcaaggatttggaagagactgagcgtcagtacggtgacgattacgccatcatggcagcacatcttcttttcgacatccacaaggagacaagtacgtacatctttagtttgcgctgagaacctctatgacgctcatcttgtgcgcccgtcactaacacttaaacatgcattgcggtctttgtttagaatcatactttcctctcctgaatgccattttcatgctggagcacgccttgaacgccagcaagcacaactaccagttgaaacttgttttgatccgcatgtacgagttgctaggtaagtcttctttcgtcaacgctgtatcttctacggcatcgccctgcggattgtctcatctaactaaagcgcgcctttctttttcatgctaacacgtgctaggtgccttcaattgcgctaccgccatctacaacaccatgggaatcaaacatgtgcagcacgacactctttcgcactttatcacggaccgtgccacgagttttggactgttcaacgaggctctgacacaactgtacagcgcccatgagatctaccacagtaacgaggcagaggtaggcatacattgtgaacaggggatgagcgttcaaggtttgaaggggatcgagattccaccctctaactcgaatggaccaactcgcatcctagacccccgagatgattttgcaggcatacaagtactgcacgttttccaaggtacgatgatgcttggacaaactgtgtcggacatatgggccgcgttgagcaagatgaaaactaaacagtcttttatggccccggagtagatgcaagagttcatcgagttccagtccagactcgaaaactcgcttcaaaagatgattgccgaccgtgaaatgatccgtctcgagttcatgaaggaggactctgtgagccgggcgatcgcatggcttcaagagctagagatcaccaatctcaaatatgatggtagctgaaatcgaatctgctttttttttctgcctgatgcgccccttcatttcgttgtgcgctctttcaacatactcattttattccttcctctacctccgtctttcccgattagatgagttctgcaagtcaaggatagacaatcgcgacacgagcgtcatgctgaactggaatcccagggactctccctcggtcgagcttttgacacgcgccgccgctcagcccaaccgcgtctggatgaccctgttcacgctcgtcccgcgcattctgaagcacatggctcacctcacccccattgacgccgaattcgaaaagctggtcgaaaccctcgagagcttggtagcctcgcaaaacacctcctcctcctcctcaacgcacgaactgacgactgaggaagtgaaggtggctcaagtcctatcgcgcgttgccaaagcctaccagttgctctaccctgcgatcgttgcccagaacagcaacagccccacgaaggaggaccctgccaagactgcagcggcgatcaaagaacagttgacggctgcaggaacgctcctgaagcgggaacccctcaagtccacgggtgtcttggcctggcaaacgttccattcgctgacgagctcggtcgagttggctgcatatctgaatgtggccaaccagtgcttgctgaacttgatctcgaccaaggcccaaaagaagacgaccttcaaggccgccacgggcgtggttcaggatttcatggcgcagtgtcgccaggcgttgcagtcggcgcagacggacatgacggcgcttaggaacgtggtgagaccggaccgcatcaagtctggcctgctctatgaactgtgcgatggatccgcggtcgatttcgtccgctctcctgtaagttttgtctttttcttcttttttctcgtaacattctttcatgttggggacttggctttgaaatcgtagacgcatcttactaataacgacttttttcgtggctgcccttccctttgttttacgcgattttgtcatcattcagactcaccaagcgttgatcgaggacaagattctaaagattggcgcgagctggatgaacagtcttgtcaatctgcagcaggaggccgcttcccgaatcgtttagacacatagatagattaacaccaaaaagaaaaaaaacctccccagccaacccacccccactggttgtgttcatttgcaactttagagagtagaaagaagaacaaaatgaacgatagaaacaacgagtttctttgaagtgaacaaaaaaaaaaaaaaaaaaaaaaaataagtaataatgatttcagtgctttgtatctgttatgagttctttctttctctgtctgtcttgctctctccctctagttcatctccaccgaccgcccaatctccatgcgacaaatctcctgaaagatgttggtgatccgagcgtcaatctcgttgcccgtctcgttatcgaccgaaaacacaatgctctcgagcgtgcccgagaacgtcgtgacctctttcgaataccggcgacccagctccaggaaccaacccagtccaatctcccaccagcggttatcgtccacgctctgacccgaggcctcgatctccttgagctgcgactgcaacacgcccacaaactcctggtacagaatcaagaacacctccttttgctcccggttcacgatcgacaatgtgttctcgacgccctccaccacttcctgggtcttagtgggtggcacggctattcatcatggcagtcaaaaaaaaaagcatggtagagtcagtatcgtgaaatatagatataccagaaacccacgggatagagcaaactaaacggtcttttgtcttaccttcaaactccttgcggacttcgaccaacttatccttgacctgcgcaactctcgagatcaccttgttcagcgtgttcttcaagatatcccaaacaaagctccgatgccactcgttctgccagacctcgggttcaaagacccacttgacgatcgcaatcgcatccacgaccctatagttgagcatcttgtccagcagaattcccataaactgtgtgttgttcttccagaactgggccacaatcttgaccgtgtgcagacgtgcctctcgcgtgctgttcatccgttgcaagatcgacaggtaacgctcaatcacgttcaacacgtgcgagaacgatttcgatccaagcatcaacacacactctgtgaacagctctcgaatgaaatcctcacgctcgttcgctgtcaggtcctccagtctcggtgcattcttcatactctccagggtctgctcgatctgctcaatcgagttcttggctcgcaacgaattcagtactgcagaggccatggcgtggtagggatgttctacaaaggagatcgagtaaagcgagaaatgtcagcacaagctgtcttctgcagattggaaatagactgaagcgataaaaaagtttccatacctggggactcaaacttccatgtgggtccaggtgcttcttcaggcatgaacttgtgaaagtcctcggggatggcttccttgatacgctcatagtacgaaaggcggatagtcttctccaatgtttcgcgaataaacacggcctggggatgatcggcaggtgcctccagagcagcagacctataatgaaaaaccacatgaatcatatcgggtgagttctcagctcccagctactatcagatacttcaaaagaaaaactgaatccccggcatggtgtgcaatcttaccattctgcccagttccagaggtagccaaagttactgaggtggtggctcaaccaagtccagaaacgatgagcacactcgatatccatagaaggaaggcgctcatacagctttgaaatggccttagctaaagctgtagggaagctgtccgggaaagacttgcagacctcgaccaggagcgacgcatagtaaaccgtcttgaactcgggcttgggcaacctgaacatctctgtgaagatcacttcagccagcagctgatccacagaccagctgggtcctgcaggcgtgtctgtctccatgtcctcgggtttgggtgcaactgccgctgctgccaaggcagagtctgcaaaggtgccgatgacataggaatactggaccatgaacaagtattttgcgcactccttgcggttgatctcgaacagacaaagaacgtccgtgaggttgtcgtgaacgataaagtgagcgatagagtagggatctgggagggaggacgcctgctcctcctcttcctcgcccaagaagatgcggaagagtgggggtgggaggtagtatgagatcgagtcggtgtgaggggggaagacgaatgcggggagctcgtgttgagaggccattcccaaagctgcatcaaaggcctgcgaaggcttgatgagaatggacacatcccagtcatccttctgaaggttctgcatctgcttccacagcaacgtcaaagactaagtaggaggaaggatatggttagttcctgaaactacgtaatccatgcctcgagtgaattctcgcttctttagactcgtcattcgtacctcttcctgaacataagggcattgcgaatccttgaacaccttggtgatctcgaatccttcgactccttcgccctcctcccgagcaatcatgtattgctcgatcctgaccagaattttgtcaaagtcatgggggttgcgatcacgcatatcggcagcacaccatggcaatgtggcgaggacacagaacacggcacagtcggcgcgggcctagcagaaaacgcgtgaaaacaaccactgatcagcttcaaccgtttccgtcgaccgggtgaaacatgcgatcgcattgttgaggtcctgcgctgcttactctcagaactgtgggttcttccaggacggccaagaactgctccatggtgttgagtaaggtcgttggcagaatcacgttagagttgaccaactcgccaaagaatcgcagcaacagcttgacatttctccactggtactttgccaaactctcatgaagcaaatcagacgccatgctgacaatggtgcctccgatctgtgcattcttagcgttcaacaatcctgtcaacgttccgtagatagcggacttcataggaagctccaaaatactataggcgtaattgtcgtccataagaacatgctcatgttagatcgtagatccatgcccatttccagactgtagatgtagtcaacctgcggaggggatctcatgacagtgttcctaccaggctttcagtgacttcaagattgtggcggagtgcttggcgtaatcattgtccagaattccagccaacgtgttcaagttggtctcgagtgtaggagtgatctgaaatgtgatgcatcaacgttagaccttactgctttaccgcaaaagcattcaagggagacgcttgtcctcagttaggaccatgaaaagtgcgatcaagcagttaccttgtcgccaacgcgaataataaggccaccaagacgcttctcgatgtcgccgacttcatcctgagcacgatcctgctccctgtcgcgctgatcgtttcgtggcttatcataaggtcgtcggttgtagccgcctccaccgcctccacgaccgcctgatgtcaaacaatagaagccagcagacagatgttaacaacctggtgctaacttaccattgaacaccgccgcatgtagaagcaagtttctcgatccctacctctctcgaatcggtcgttgcgttcatagggacgtccaccaccgccaccgccacctattataacaggagagaagagcattgtcgaacagagtgggtgagtaacacgaagacgtgttttctccatgaagtcgccatcagtaccaactccaaggcgaccgcaatgcgcgcatgaattctctgcctccctccgagtcgattagaatagagagctaaagtaccgtagttgttcctgttcctgtctggcccgcctccgccgccgccaccaccgttgtttcttctgtagtccatggggttgcttgacgtttgagagagaacaagttcgtgcatcaaaacaagcaagatcacttttgataggccatcaaaaaaaaaccagtacgtcatagggtaatcacgtgatcgtaaacgtggaactccgggaggtggcattgtgtcgacttttaatgtagcaggggtcaggtcaagtaggtggaaaagtgctatcctactctatatagtcgttgtgaccggacactgctgttacacttcatgagagaagcatatcattaaggatgtcgagctcgtactgagcatcttgaacgagcgacatggactattttgagggaacttacagaatccctatggctcctctgtttagaatgtcctccttcgctgatggcggcgataaactattttttgcggattcgatcactgagccatactatgaagtacaatctgaattcttgagttttccttgcggttttacaatgtacctgcccgtcgacttgtagtgaatttttgcaatacctttgcacagtgcctttgtcggatacgctatacaggtaaagagtgctagactctgccaacgcgcctatgcgcatataggcctacgagctcttttttttttcttttctcgctctcccaaatgcgcatgaagagaggtataaagatttcgctgatgtgcattatttttgatcgtcgagagggttatggttagaccgagctgcaggagttggacggacagagcaaggacaagagagcagtcagcacgcgtagtttcgatgtagtatccgcgtttggatggtcgtacaggctaaaaaagtgcattgtcgtgtgcatgaagtgtgttcaaaagaacattgagttgaagcgatgctattgggcgagatctctaatgaggttgttgtccacgggaacaaaatggtacactcgtggtcgtaaaggctaaaccctcgaaggggagggcgaccatcctaaacgacaacagcagaaacaactaacaacaaatgaccagattatcatcatcgatctgtcgactgtactactctgctgggcgtctcagctgggagattctttgttggggtatgatttctttttttcttttattgcggtcagcagagaacagggtccctgacgacggtggacaatctacatctcactcacacacaaaagttgtagtgggcgcgtcgtccaacaaaatcacagcaggtcttgttgaacaaccccccttgtaaagatatcagtggatgatatcctatcatcacgaaagaatgctacagaatatcatgggccaagcgggaaaggggtattgggcgatcagccgcaggtttggacctttcctgccatctcaaacctcacctcacccacctttgtctgcatcaacctgcatctgcatctgcaccgttgtagagacaggaatagaatagggggaggaggaggacaaggtcaggcaagcctctccatccatcggttcagtagcccaacacctcttggttcgagtagaccttctagcgagctctcttaaactaccttgtagactagcatcgcttctcccctcacacaagcagaggctattctcctcggtgcgtgtagcgcctcaaagtcaaaaaaaaaagagtacttgaatttttagtctgacagcagctcatccgcgccgatcagttcagtctcacgcattttaccttgtaggaacaacgtttcactcaagtagcttttcaacgaggtatccgattcaagggagcagcaccaaataaacattcggctagcggccgcgttcaaatacatgtctcctttttttttttctttcttatggtcctctccatgagcagcattaggcatgacaatagaggtgtgattcgtcattcaagggggcaatgctcaaaaaagatagctgcacgcgatgttaatgttgctgtgaagcgacgcatcaacagccactccatgaccctcccttcttgaactttgtaggccagggcaggtcactgagggcgtacgggaggagaagggagggagggagggagggggaggagatagacaaagacaaggttttctttgaggaccaagggcaagcatgggcatgggaggacagggcatgacaccttttgcacaagaggggggggggtcaagaaaacaacactctcaaacttgcccatatcgtctcgtcgcacttttttttgcagcccaacctacagaataaatccaaaacgcattcccaatgcaagactagggcgtacatatcacctgtatgcacgtatactatgtatatacagcacaagtaccctcgcatccacctttttcgcaaggaacggaagggagaaggtacatttgatcatgcacatcaacaaaggaacgaggcattatttctttaattgcctagtccgtgtcctcttgcctagctcgcgcaaggagagagacaaaaagaaccacgcaaagaaatcttagagacagcatacggacgcgcgcgagcacaaagagacgagattgtatgtgcgagaagagaagtcaatgtctgtatattgagaaagagagggaaagggaaggaggtagggagaggaaggcattcaatcgaagcgagagctgggcgtgcattgtgtctctctgttctcctttttggttgcatggcatgcaaggaggagccgtgaacgtcgagactctaatgagagtaggtagaaacagagaggagtctacggcttcatggcatggcagtaagaattggggttgagaacggggaccatgtcgacaagcgagggggggagaaaagggctcaccgaggcttacacgctgtgtttgccactgtcgcccacagcagcagtcgatgctctgtgctctatgagcgagtgcgtagatgtccaaggaggtcgagatgacgagcttgcgactgagcctgtcgctctctgaccttgagtaaggaggtgcgccccaccagccagcgtcattcctgtagtgtgtacgggcttcaagtggcgtgagcatgagcgtgttacgtgctctattccctgacatccactgtacggctctagtctcgagagtcgagtactttttttttttttgacgaggttactgttgtgattagtccgttgtcattccttaatgaaccaggagtgctctagttttgctcgttcatgcgtgctacccgtttttcattattatttctgtagtttgtgcgcttgtttatgcaagttgatatcaagagtagaatgagcgcaaggacacggacgcaaacccagcgtatcgtatggcgtttgaaaaggggaatacacgcgagcactaaaaaaaaagagcgcgaaggaatccttggtctatgacagcactctgtaactgtcaaatggatggtacttcctgaacggttgctggtacgattctggattcagacagccgtgtctgatagctctttgctcgttctcgacgatgctccatgcatgtccatcgatcgatcccatcgtgggcttgaacaggaatgatggccatgtctcttgtctctcgtatttttttcccctctctccctggacctcattcatgcaaagcctattctgatccccacagacaagaggagaagggggggggggaaaaagcagagacgagagaaacgaggcagcaaaaaaaaagctcctttatgcccacctatgtccattgacgaccccggggtgtctttgttctttctggcccgtcagaagggaatggagaaaagtcatcgtctgaaacagacccaaggcagagcacggggactggaaggacgccgaggatgcgggtcaaagacggacgctgccagcagcgagggaccatgggcctttagtttttccttttcagccgtttcgactgggccagcacgtccgtcgatataaaaaggcaaggacgggatctccttttttgtgtttgcctctcctccagctcgctccagcttttctttcctgcctcgtccgtctagacacgcctccacaccctcgtccctgtacattgcagcattgcaccatcgcacatcgtttccgcctgttcttgttccttgtatatagacacacctacacgacccttttccatactgtcgtcttcctatttcctgtagatacttttttccccagagcgatcaaccttaaaaggcggcttcatttgacactagcacgactcgaccgcgcgattctattggtttctattggtttctatcagccttctgccgttctcgacacacactcacacacagcttttagtgcgccccagcgtccgagtcaaaccatccgccagccaagcccgacctgacagcccacaacaattcgacaattgacaacagttgggccacacaccacccagcagcacggcaacaacaacaacaacagcaacatccaacccgcccgccagccaagttgtgcaccctgtctgccgctgattcgtcgcctgctgttctatttcgtattacagtcgttcatattcaatcaccataaaaaccaaaaggtgcgtatgtccccggtctatatttgctgtttgtattctaaaaaaacgtcatgtccacctgctgactcttttattttcctcgtctttcttcgctgtcgttccaccctgtcactccagattcgtccatcctctctcggattggcccatcccgcccgcctcttgcgccagtgcttctgcttattatccacacggcgatctgtcccatatcccaacatccccccagttcctttgctgctttccctgctgctttccctgcttgctcatataaaaggccctgaccctgcagcccttttctcattctctcttttcttctaatcccactctttgccatccctcgcttgttcatctgttcatccttgtcttctctcgttctttttctctttttttttttattcccttcctcttttttttttatatccttatcccctattcctatcctctacacacacacctgcttgcattcaagatggccgtctctcactaagcacctgcctccctcccgggactccccagacacctcctcctgaccactgcctgccctgccagcaccccacctgaacaatgatcagcccctctgcccagcctgccaccccaaccgcaagcaccgcctgctcctgctcctgcacctccacccgctacacccactccgcgtctcctctgtcgaccgcctccacagcagcagcaacagccatcaccgtcgctccctcttagcgcctttgtcctctccgtccgtggttcaacacttaataccatctacacacacacacacttttgcttcaagcacacacactcaacctgtatagctcccccttgcacaccagccctttatagttttttggtctattttgccgcgcattattctctatttcctgtgaccccaatcgtaatccacccgtcctaacctacaagctatgcaagctatgcaagacaccaccacactgacagccactggcgccgcgaccgccgacccctggtccttggtcggatccctcctcagggacacccccaaccagaccgcctaccagatcgtcgacgtcctcggatacggcacctacggctgcatctacctcgccaagaccgtctccacctccacctcgcccgcctctgacgcccgccccgagtacagggccatcaagtgcctctccaagcagggcctctctccgacccagctgctcatccagcgccaggagatcgatatccatctctcgctctcgtctgtcaaaggtggtcaccaccccaacgtcgtcgacatggtctcggtcatcgagaccaaggattcgctctaccttgtcatggaatactgctcgggcggtgacctctacgacgccatcacctcgcagcacgccgccgcctcggattcaggtctcggcttcgccgccgctgcacctctcgcctccggcaagggtctcaatgtccactcggacaactctgtgctcgaggccatggcccagatcatctctgcggtctcgcactcgcaccgccaccaggtcttccaccgtgatctcaagcccgagaacattctggtcgctggggacggttccctcaagctcgctgattttggtctcgccaccaaggaccgcgtctcgtctgattttggctgcggaagctccttctacatggcccccgagcagcagcccactgccgcgcagcagcgcggtggcggtcgccgcccttatctgcccgcaaagtccgacgtctggtccttgggcatcatctttttgaacttgcgcttcggtcgcaacccctggaagtttacgcgcgtcgaggccgattcgacttttgcggcctacgtccaggaccctaccgtgctcgatggcatgtttcccgaactgtctgcgagtgctttgcactttttgcaccgcgtcctttgcgtggaccccaacgagcgcgccgattgctttgaggcgatggagttgcttcaccgtatcgacacgatcgtcagccacaaggacactgcctcgatggaggagtgtggtgagaacggtatcgaggacggttcctccgagtttgcttctgcagattcgtccctcaatggctcgcgttcctcgtcttccatgtccgactctgcctccatctcttttggtggccacggatcctttgatgaccagcacagcggtgccatcttccatatggagggtgactttgctggtgggaatctgaagacggatgagcgcagctggtctttgacttcctctggcaagtcctggtctgatatggcagatgaggaggagatggacttttctcagcccattgaattcgagttccagcagcagcagcagcagcagcagccacttgacttgcttgcccaggctggcatggtcaagttgtcagacctctttgcttccaagacctccactgtcgcctaaggcggtggtagttgtagtgtaggcatttttttttctttctttttttcctttttttttttttagatagcacatttctttttttttttttcttttacttttttttttcttttttttttttttgtccccaaccattctttttttttttttttttttttttctttgttggcatgtctgaatatagctctatagtcccttgttgcaaagcaatcgcattgtgtccctgtatactatccaaaagttgctcataaaaacatacacatgttcatgtatatacatccaaacacttgctttagatcaaacgacgttttttttttattattactcagtcaggagaaacacatgtcaaagaaggaaaaacaaaactcttgtgctacttgggtcgtccctgctgttctttctcttcacgcttctctgcaggcggctgcatcgcagcctcggcataatccggcggtggtccgtcataccccgacgcagctacaacaacagcagtaccgtcctgatcctgccgcccctcggctacggcgggctccggctcctcacctactcctacagggatccggaaacccggttctgctggaggcagcaccgcatgtggattccgcggcccctggggaggtctcgccggtgacggcgacggcgacggcgacgacgttgacatggatgtggatgtggatgtggcagccatatctgctgccggtgaggggactggagaggtactggtgggcggcctgagtgggaacgagacagaaatgggctgcgaatgacgcttgttaccactgccaggaggatccggcgcggacccagggatgtgtgggatcggcatggacatggggaggatcggcacagtgtcgtaggtgggccgtggcatctgcatcggcacgggcatgtgcatcggcatgggcatctgcgtcgggagcggacccccatgaccgccaccaccaacagcgacccctcctggcggtccgggtgggtaagactgcaaatgaggctgctgtgggaacggtggcgactgcatcatgagcgggtgaggcgcatggcctgcagaagcgtaatgttctcccgagagcgggcgtgtcctgaccggaggcgaagtcgacttgcgaccctcgaccgcggcgccgctctgtccaggtcctccttggctggtctgatatgtggtcgcaggcgtatatgtcgttttcggcacaaatggactgggcggggcgttggtgggcggggtgggggccgcctcagagaccgcagccgtcgcagtgtcctcctcctgctccttcctttcttcctgctgacttgtgtttgctgaagcagcagcagcagcagcagcagcagcaacgactggcgatgaaggcgcaacaaaaacagggatcggctcttgcttgggcgtggaagcccccgacgcggaggtgctaccagacgtggctattccagtactcaaatccttcacagttccatcttccagctcaggggtgggtgggatctcattgatgacctggaccatcgagacaccgtcgacgtaggtcatggtcgtcatattcgacgacatgctgttccgtggagaggcagagcccgtggaggacgaaatggagctcgccctgtggtgtttgggtgatgcggatcctggggatggaggagactgcagattgaaccagtcggatcctgatttgatggccaagtcttggagcatggcgtccatggcttgcttcgtgtcctttggaaagtcgcctaggtccacctctgtgatctggaccttgggttcatgagaggaccaggtcttgaaggtgtcaagacaggccttgacggcataagcagtccgtgctgcgcctttttttttttttttttttttcatatgacacattcacaaagacaaaaaaaaaagtcagtcaagattgaagccaggcactagagaaacatacatctctcaggcaggaacccaaatgttgccatccttaccatcatacgctccatagtgctcatctgcgtgtgatcccgctggcgtaggggtgtcatccagttgagtcatgatctcccgcccgtaatgtgcgaccacaatcagttccttgcccaatttctctagagcatccaactgctgagccgtcgcccgtttgatcctctttcgtttcaaatcctccaactcattctccacctgtcgggtctcctgtctcagcagcttcatttccggatgcatctcgggtcctctcaggaccgatgtggacgagctggcgggcgagatggactggtaaacgtgcgacttgtccagcgatagcttctgttccagatccagcttccgtttccgtaccgagtagttctcatcctcggccacccgaatctccttgaagagctcacgactctgtcccagactcgtggagtaatcccgttcaagatccgcggccttttgaatcaagagcgcgagcttggagagcgtgtccgagatatcgggtccctcggtcttggcgtaaatggccaaatggtttgcggctgtttttttgtggtgtggaaaaaaaaaacccccccaaaaaccgagagttagccatgaaaaatacacttgatggagtagagagaaagtgtatgtgctggttttttttttttttttttttagttttctgttggctgaccttcttccttctcgaatgcagtgcgtttgagagaggtcaagacattcttttgttcctgaatcaggatgcggagttctggaacaaggccactcaggggcgagagaccgtcgatgccgcgcctgatgccatgcgcaatcttggtcgcgcgcaggcaagggtcgatgagatgggccatcagtctatcctcagtgaagttcttttgctgttactgctgacaggtggtagtgttgcttaaaaagggggagcgtgtgcgtgggagaaaaaaagaaaggcagccgaagacgagaagggagagataggtatggctgtcgggtgtgcagttcctggagcgctgtggcaaatggtatagtggtagagagacaggaggagaatgtgagagtagcttgaatgtgaaaggaatgggatgaggagagggagtgaagagcgagtggacctgaggaagcggaacaatggtttggaacacgctagaccagccgtttgtcatttgttgacgcttacaatagcatgaaaaaaaaaggcctctgaagaatgacagcatcggctgtccatagactattacagtatggcccactatggcacagcgcggccaactcgggccgcggcaccaaaagcgcgcttctcattcgcccactttactcgtctcagtgtcagccataccctcgtcggccatcgccagaaatagcggcctcgctctggatcatgctacggcaacggacggactctgacagaccgatcatagccatggggtccatccctcaaacatattggccaggttctccacattcgtggcctcttggatcacgcgctcgacctgctccgtcaccttgcacttcttgaccgcgtcaaagtctcttccctccagcttgtgtcgcacccggcgcaggatgttgaccgcaatcgcatttcgctgatgcagtggcggttgctgctgctgctgttgccctggcacgggcgactgttgctggagctgctgcagatgggcatagctattgttgttggtggtgactcccagactcagggtcgcagaggtcggcgtcgaatcagtctggtctcctgcgctcacattccatctgcgatacgacgagtccgtcgtcgttgtcgatttgatgctcatgctgctgatggacgcaacactctcgctggacatgcggcgtcgaagactcagggaccgtgccgagtaattcgtatcaaacgacgaccgcgagtcgcgatggttcgttccagacacactgctcgtctcgctctcgctgtccaacaccagaccttggtgaccctcacggatggactccaggcctcccacgactcctccaccgcctgcacctgcacccggtgccgtcccagcctcaatctgccagtcgaccagcggatcgtaaatgaacgcttccaggagcgtgaccaggatctccttgttcttccgcatcaccttcatcgtctgctcgcatccaatcctaaagttgccctctactccagtcacgccgagactcgtgagcatattccgactcaatcggaaaggcacaatctctggaatccgaagcatcttgcccttctcgaaacagacgttgtagtcgatatgaaccagatcgcctgtcttaaagtcgatgaggatgttctccagatggcgatcgcccagtccgatcacatagccaatcatcgacatcacggcagtcgaccgtgcgaaccggacagattttttccaccactcgccaggcgtcggacttgaggaccaaagctcgtgttccagcagatctgcaggtgtctcgctcgccatttcatggtaaagatccaacaggattgatttcggccattggcgacgcgggtggttcgaaggcaggccagccttctttaaagcgactgctgccttttcgtggtatacatccgtggctcgaggtggactctgatgagggtgtgatacgccgtcgtcattcagcaggcgggaacacatgagctcccgatgctgccatttcgcgataatcgtaaagatcgaaaccgtgttctcaacccattggatcatgccagagttgtcgctcaagggaacgacagcataatgtcgggctgtgagctgccgtgaattggattccttgtcccgttgaagcatgccgtttgtgatccgcaaaagctgcatgactcgctcgtccaggtgaaggtcctcgagacctttgaaaagataggtgtatcgcttgccgtcagatcccaagagagtcagcttctttggcttggtttttgtggggatgatgacgacctgctgctcaaaggagtgaatggtaactcctgttccttgcttggggctcgggatttcgattaatgacgactgaattgacgcaagatccggactgaggtccgacaactgcagtacccttgcgccagaaaggtccttgccaatctccatacagatctacaggtgaagaaacaaaaaagaattgcaaggacgtcagatctaccctcactaaaccattttcaacatctttcaagagacatttcatgcattgttacctcttttaacatggttaatccctcaaagagactgctccaggcctttggtgaccgcaggctgtccagggcggcttggattttatccctatacgtcgatatgaaccatcgctcatgattcgactcgggacgagcgtgcgcatcttgcaagctttcgaacgtggctaacaacgggatcaccgattgctggtagttgtcagacataacagcgtccttgtcctctggtcccagtcctgaaatcgtatccagtccctggtactgctccgttagctcttgtaatgtgctctttagttctggcaggcccgtcatgatctttttgtaccagacctcttcccacaagactgttatcctctccaactcacggatgaggtgccgaacctgtgagaccagctccgggtgcgacttgatcagatgctcgccaatgaccccgaggagcctacgctggcagggtgtgttatgtgcagagtttgctcccacaacgcaatgaaagacgatcagctgcgggtactgatctccaatcttgcagagcaagtctgcgatcaacgactgcacaggcttctccgggtggtccagtcgagcaaacagctgggggataatgtttgtccaggggctgacgttgatgtccaccagattctcatgaaacgcgtcatagagttggccgccgtgcttggcgaggagtcgtaaaaggcgtagggtcgctgtgatctcatccgaaatggccgactgcgaaatttcatccgcagcctcttctccagatgtggtctgttcaaatagatattcacaagaccatagtgacttagtgctcgctccttttcgacacccggtgtgtgcaacatgccaagtactggcaacatcgatccgtatgttacctttgactttggacgactgcattcaaactctagtgaggcaaactggaggaaccggaaatagccgtgaaccgctaggcggtacgactccaagatgcgctgtagcaaggtctggaatgtcccaacgatctcagaaatcgcgccttctgatcctgccatttgttcaagcttgatgagatgtgtcctaatgctctcgtaagcagccatctcgtcgaaaggctgtcccgaggcacaatgcttgacaaacacgcaaaagatggactaagcaggaacaaaaaaaatggtcgcgaggtcagcgaattgcttcatacatgacatttgtaccacatggtccctgatatctacacttgcctttgcatgttcctctgtattctgtactccggcattggacaggatacttttcaacgagtcattggccgccacagcaacgggatgttggaatcgataggatccaacctcgtccaggataccccatccttgcttataatgatgcgtgccaaatgcgaaccaagatttccgatagttcgtgccgacgtcaacggccttttgaagacagccagcggtaatggattcgattcttgcctgcgatgactgtaccgactcttgatgcaactccaaaatatcctcaaaggctttgatatcatccgccgaaaactgaggtttcgtgaggcgtgaccattttgccagtttgagataaatccgactctggaacacagccatgttctggtcgtccatgtcggaggatcgtagacccttgacactgtctaatatccgcctcgatgcgcttaacgctgacggataatcatgcttggccacagccgctttcgcctcctcgaactggatggctggcgacagggctccctcccaggtacgcggaatgctacaagcaaagccatgacactcggtcctacgcgcgaccttggatagcaagaacttgaactcattggattgcttgagcaccagggaagtgttgttgctagcataattctttgccaaatccaccatcgcatcgagtcgcgtccagtatcgtaaatctttgcgcaacaaggtcatcttgagctcatcggggatgctagagagctgatccacgaaatcactgactgcttgagagatgccctccgcaggtgtgttgagcatcaaggtgtcaataaggactccgctcgcggccccaagtcccttgcgtaccagaaactcggcggacggctgagcagtcctaagcgactcttggcgaaggtggtctaaagccaaagtgcttgctcctgattgctggtacactttggacacaaacatgaagctctgccccaccaatctgcctcgctcaaatgcaacgttatcggacatccgctcatccttggtgtcctgcttataaaattcctccagctgggaccaagcctgcgcagggtcatccagacaaaagtctctcagactctgcagtgccgcatcatcgttccagaacattggctgtatcaattgggggtccatgggggctgagtccaaaaatgactggagttgctggtagctaccaaggtcactcaaactctcagatgtttccctgtaaagaaaatcgatatgcggtctgatgtcctcctcagattcttgctcgtcacaagattcgatgaggtgcatcgcttccttcgccgactgttcgtaccgatgctaaagagggggaaggacacgaggtgagaaacctgcgcggtgcagttataaatcgcttgacatgtgtgtgcctcgtcatggagccggccgtggcatattacctgagcatgaaaaacggcagtgttgatccaatccagcgatatctgggaaagcgcggctgcctggccctcattcagattcgcgtttctgtaccttgggtctgcaggaaggataggcgaggtctttcttttttagtattttcagaggtggcgttgacactcatatgctgcgcacaatcacacacgagacctacgtacaatgtgtggagcgctccgagcgcgagtgcttcaatctacctgaggaaggcgccttgatcatgtccttgatggctcttctacaccatgtgtgcaaacccgagatggcgtcggatccgttcgttcccgcaagggccgtcactgtatttgataactctcagcacattagccacaatcgtacaggcttcatatcccgttctaaagattgtcgtgcctacttaccgaggtcaactagcgtctgctcgaattcgtccagccactgaaggatgtcattaacaccgccacgactcagattactgaaaagttcggatagcagctgagtagatgcagaccaggtcagtagcagaaggagtaggtcgaatcctccaaaacagggctcgcatagagtgccacgtaccttatacccgttgcgtatgacgatttcaacttcaccagtgaccttggctccttggatgacgcggcttctgatccgtgcaaaccattcatcccacatctttttgttcgatctgacaaatacaatgacgggtttgggtgttggagggataacgcctagtgctgttccatgatgcgcgttgtagatctgaagctcgagtcgatccaagaagattaagaaatcacgtaggcgagccagtctaattgcaaagaagtgtgaggacgatgcatggagcctagtctagcgtgggtcgcaagtgaagaatgtattacctcacgtttcctgaatcggttttggaatccagctgcaatagaccgttgagctgcttttcaaaggcatcaagagtctgctgtggccctccgtatggcgtgcgcaacctcgagagcacgcaatactttgacatctcccacaacgaccaatacgtcaagagttcgtgtgagtgttggagtgtttcaacctgctctgaagcgatgatgtctacaaagccatcagcaacaaaaacaaaaataaaacacccgaggttagttaacgagcgccgctaggaaagactaagggtgcacacttcagcctcttacctgcgccagattcttgattgacctttgcaaggatctccttcccttgacaggcgtgaaacaggcgctgaagcatatctccatcctgcacaaaagccacgccgctgtcgccgctttcctcctcaatcggactcttgtcattggcggccagcgcagacatcatcgaactgaaatgtgggtatctgaaaacacctgcgtatgggcttctcagcacaagaatctagtagcgccaaagttagtcgcggaaggacgaaatacgagttgcatcataacagacaaacatctgcaaaatctaccttcagtgctcgggagatatctgtttcctgaatgtcaaagcagtcgaacgcaaagacgaaagggtttagctggaagagtgcattcttccaagccctgctgacacttggagacatatcctgcgtcctgcaatccaaaagagaaatcactcagcatctttcctttaagcgtctatgataccaaaacctgtcttctaactgcaaatcaacatacctgtccgccatgtttgccatcaattgaggaccgaggctgaacgaaccgaacgcactagcaaacgattcaaagacagtcgcaatcgctgctcgtatttggtcgtcctcatcggcgcctgagtcaaatgagaagacgtcagaggcttgcacaaaatgttatagcgcaacaaagtcaatagactagaccctacggtcttacctgcaatgatgataaactggtgcagattcgacgagagggactttttcaagtcaggccacgttggtgatgccgaatttatatgtcggtgctctcgaactgctgccaagatatctgcagcccaagtaattgcgcaaagttttatcgaagctgagaggatcttccaatgggtcaacaacgtctgaatgaaatgaagcgacgtcccaaaggccagcgactgtgtgttcgcagtttctgctgtcggcaaaaaatactgtcggctataaaataatttgagtaatggagttttgaccggcgcattgcttcctcagctacgcatgtattacctgacggagatctctttaagagcgtaaatgacgattgccaagcgggattcaggtatgcaatccactgttccgagtagccgcaggaagatcgcagacgcctcatgaggccagcatctggccatctcaatcaaaaagagaatgtcaaaggtcaggctagctatcaatgatgcagcagaagctcctgtatatggagtgtgatgagtctggtctccattcagctgagcggtgaagcgtgagagctgtggcggaccatcttccagctgaggctgacaatcctgcacgattgacgcgagattcttcgcatcccataagctcttgccatgcggcagctcccgtactatgtcctccacttcatgcatgacattgctccatacttgcagcgtgatgttgtggtgctcgcgctcaagttcaggcatatctgtcgatatatccgagagggaggcgataataacatcctgcacgttctgactatggcgccactgcgcaggtgcttcccaacgagaacgcatgagcgcaccattgggattggatagttccagagtgacttccgggtgcacacagggctgccaaacagcgagaacctaaacacgtgaatttgccgtcagcattggttgatctcagttgatagggggtttagcatgagctcggtggactctctagtgtacctttctaataaccccaacagtgttgatccaagcaagtttttccgagtaggtgttgcccagttggtccaaaagatatcgcacagctcgccgttgcaggctgtaaaaggtcgacggttgtcccaagctaaggcttagaatgatttcagcgcctacagagcaagagtgtcgcatgagtatcgccccttctgcatccttgcccaaagcatgtttgtgatagaaaacacggtcttataccagttgtgttaggcgcctctgataacccagcgacggctacaagcatatctatggcatgctcctgcagctgcttcagtcgctctggtgcgagggaagcatgtgagatcaatgccttcgcgatgatttgaaagcagctaaggtgtcgacaacaacataacagtcgcgtcagtccgcagtccgcagtccgtattttccgtgcatgtgaatcaagaatattcgctctcacctctgcaagcaagcgatggtttccttggtcgctgtgctgtctgaagtcgcttcttctgctgcgagcgcttcgatgtcgttgataaagtactcgagaaggtcctggccaaaatctgcggcggtagaccactgcactgtgaaagaacctaggacgtctgtacaaggcatacatcgacgtccagtgttagagtcgcgaaactcggtgcgcaacgccgttggaaatctttgttggtggcgttgttcgattctcattcctaccagcgatacgcctcctaacggccgcagtcgtcccgcgatcaacatgccatcctactagcaagtcaacaatcgcctggtcacagcaggatgtgtcgaacatgttgcgtcagctcgaggcggattgtgcacaatattgccatgctcggcatcccattgcgattcttactctgaaccttggctgccatgcctctggatgttggacagagagatccatgagctgatccaaggtgggtagaaggcagctgccgtcttcacttttgtccaaaatgtcctcgatatcctccagtaggactacagcagaagcaaagtctatggctgctctccctactaccgtcaatggcgtaacaaacaccaacgtcagtgaacgattcgaggtcgtggcgcgtgcttcactcaacatccttttttcacaacgtaccattgtcggaccgcggtcctcggttggctgaaggctgatgggggtaagcaggcacatgcattggtgccgcattctttggctgaccgcggcgacgagagttcttctacaaagatgcggagagcgctggtgagtcttggtaactgagaaggggcgaaagtagcttttcgcggaaggtttaagctgctgaggaagggggaacacaccattctgacgaaagggaggtgtggaaggggacaaggtagagtggatgcgcgtgcggatcagggtctctggcgctcaatgaatgcgctggtgcgtgcgatgtgtggtgtgtgagcggtgttacgctgggctggttgcggtacgtccttgacaggctgcgtggagggagcaaagggcacgaggaagaggagaagtctggttcaggctatggtggatctcttcgcgagtgcagacagcatggctaaaagtgatgaatgttgttgttgaggctggtgttgctgctgctgctgctgcttgtgggtctggattgaagacggaggtcaagtgctgtcatggaaagtgggatgcaagagggatgcaagagggatgctgcgttgtcccgcgaggatggggtctaataaaaaagaagcaaaaaaatgaaaaaaaaaaaaaaaaaaaagcagtgtgacgcagtctgcagaaagaacgaatctcattcaatccttccttccttaatccctccatccgtccagctctgtttgctccactttcaatcacatccctttccccaaccaacgctttggacgatccgcaaaagtggctgcacgacaggacattcgacaggccaatctgagggcgtggcaggacaagcctggtaatcgccagtctgtgtacataccggacgagcgcaacaatgcaggacaaccgagactgatggacaggcatcactgctcttctcaatctagatccatcggccctcaagaatctggactccaacatcaagaagaacacggcattcatcaagaagtgcaagacgggtcttactgccgacgtctcgaatcagcttttgaacgacatcaagaaactcagcctcgaaaagtacatctctgagatagtcgcggccatccttgagggacttttgcgttgcaaactcagcgccgatgtggcggcggcgatcgaggtagatacttgcggagatcagagccgcagcaaacacggcaaggagaggaggttgtgtcaacagaaatctgacgcatggaacttgctctcataggtcatctcggcgcttcaccaacgctttccagacacgttcacgttgctactgacctatcacctcgcaaaggcgctcgcgccctcgccaaagttgtcacatcagcaactagcacaggcaggatcaactccggagcaacgcgagaaggaagaggccgcacgggtctcgaggcagcgtattttatgtcgcgttgccatcgatttatggctcgcaggcgtattacggaatatcgaggatggtgtggctaccctcagtgctgaaggagctgccggtgtgtccaacaaagctggccaagtggccaaggacaatgttgctggactgatcatgagctcaagcaaggactccaaaggcgcagtcgacaatgcaaaaggatttcccaactttgtttatacgattttgcacgatctggtatgcaacttgagatggcggtggcgataattcagtcgatcacctgctggactagagaggtcgacatggttgtaatgaatactgatcgttcgtttttcatattggcagcttactggggacaaggaccatgtgaaccttcccatcctgctgacagcgctaaagatccacggcaaggatttgaccgggatcacccctaaaaaggcaaaggctgcaactgacggcaaagaggcagatgcaaagaacgccacagaggatgattcggcctccccttcacgcgagtcgtttgtcgctcctgtacaacagcaggttttcaagaccatcatcatggattactacaaaagcctggagaatcatcttgtccgcgaccacaaggtacacggatagacgatgacatggacagcaaacgcagcacgaatgaggaagccgcagaatgccgtgtggtgactaatgctgtcttgtatgtccccattaggaactcaaaaaaacggaacgaaagaacgaggcgtcgttattctcccgcggcgaattgtcagaagagcgccagcagcagtttgagaaacaggccaaggcgtttgaaaaattgtcaacatcgactcaggcgatcgccgatgccttggatgtggagatgcctatcctgcaggacgaaaaggaagatctgattggtattgtggaaacaagcgctggatcagaagataagggaacttccagcagcgtctttgaggatgaagacaatgtcgtcttttatgagcagatcctggatctccgaacactggtgcccaagattttcctcgaaaccaagtccaaaaaagacaagaaagacgacggcaatgaagcggacaaagatggcgacaagtctacaagcaaggacgatcattctgcagcagactcggatcgtgctacaaacgatgcagcggacggtctggaagatcttgacgggtctgcggatcacattatggagagcattgacgcggagctggacgaccttgatctcaatgaagcttcaggaacagagtcatttttggcagaggaaacggttccaacaaccgcagacagctcaacaactgcttcaaaggcgaccgccacgcagctggatgccttcttggccaagcttccatccatgtgcaacagagatatgatcgaccaggctgcggttgacttttgctacctcaactcgaaactcagtcgtaaccggctgatcaaggtttgtaccgcatagtgacattcttggatcctattttatttgggatgaatccctgccacacatcgactaagtggataggtcctctttcttttgccaacgtagacactagtccaggtaccccgcgacagacacgatctccttccctattactcccgcttgattgctaccttccagccattctatccagatgttgcggaacaggtacttggcgctttgaagcgcgagttccgtggaatgctgcacaagaagcacgttgaccgctccgagtctcgcaccaaaaacatcaaatttttgggtgagctggccaagtttggtatcacgcccgaccctatcatctttcactgcctgggcgtgttgctcaaagatttcgtgccccagaacatcactgtcgcctgcgcgttgctcgagacctgcggaagatatctcaaacttaaaaacgctaaaacagcgacccatctggactccatgctcgatactctgaagcgccagaaggcggctctccatctcgaaccgcgattcctgcttatgatcgataatgcctattaccaggtaaatttatcaaccatgtgtgggtgcttttagaattcatggttcttagcttggtgttggatattgaccgcttgtttgtttccctggatgtagtgcaatccgccagagcagagcacgagacagaaacgtgaaattcctccaattgagcagttcatccgcaagttgctttaccttgatctctgcaagaagaatgtggaatcgactcataagctgctccgcaagttggactggaacaataaggacgtgagtgctcgttgcgatgtttgcttttgttcgactgtagacgcggggatgagcgactactgacggttacgatgatctctaaacgtctagatctacaatcttgtcgtgcgcctattcagcaaggtgtggaagatcaagttcagcaacattcatctgatggcaattcttgtgaacgggctaagccgctaccactctgatttctcaatcgccatcgtcgactctgtcgtggaggagatcaaaattggcttggagcagaacaacttccggcacaaccaaaaacgcatcgctatcgtcaagttcttgggggagttgtacaactatcgcatggtggactcgcctctgattttcagtactttggaggcgctggtgtcaacaggacatggtacgtcgcatccgtgatcaacatgccgcttgggggttttttttattcatatttctttggcagcgatgtattcagtatccgttattgtatttttgtctgtgcgtagatcaaggtcgtgcatctccagatcgtccgtcgcccatcgatgcacctcatgattgcttcaggattcggctcatctgcacactgcttgatacctgcggcatgtgctttgaccatggcagctcaaagatcaagctggattcttttctcgtccttttccagatgtacattcttgccaaagaaagcgtaccccttgaaatcgaatacatgatcgaggacacgtttaccgagctgagacccaagcttcgccgcttcgagacttatgaggaagcggttgcggctgtcgaggcattgcttggcccattgggtagcagtgagcaaggctcaagtctccagaatgatgattcagactctgaggaatctgaaggtgatgacgacggcgatgatgaccaacaggatgaggatgacgatgagagcgatgaggacgaggacggacttgatgacgacgaggagatgcatgctatgcgacagatggacgacgaggaacaggctgttgttctcacgaaccaacacaagcaggaggagcctctggacgaagactttgaacgggagtatctgaagatgatgagtgagagtctggagtctagaaagtttgagaggaaacatctcacgctcgacgtcgccatccccgtactgagatctgctggtacgttgctggaatattgctttctctgtaaacatgtttcttctcctcgttccaatgatagacttgcgctaataacgacactcatacttttggttaaatagatcgtcgtgaggaaccagtcgtcaacaatcctgaccatgtggctttcactcttctgacaaagaagggcaataagcagcagctgaagactgtcgggctcccgagtgatagtgcgctcgttattaacacaagaaatcaacgcgaagccgaacgagaggaacagcagcagctcaagcagcttgtcttggagtacgaagtccgcgaggaggccaatcagcgcgcaggtatggtccacgatctaaggctgtgcagtgattgggcgatgcgaagtgatcgacaagcgaccaaggttgctgacaactgcattgtcattccaaccccctattagctttggaacaatccttgcggaatcaaggcttccgtttgaactttaccgaggagaacagacgcggagccatgggcttgcgtgacaacagtacgccccattctccaggacagcagcgaggtgagcgtggcgagcgcggcgaacgtggagatcgtcctggacaagggccagatcctattcgcaatcagtcgcgctgggctcgtaaccagagcgtgggtgttggagctggattcggcactgagagtgcactgaccaaccttggcgtcgacggctatgagaggcggcccgtaggaggacaggccagccgaggtcgtggatctcacacccatggaaggtaataagcacccgtgttatgctttgatcaacatggtgggccgacaaaaaacatcgttgcatgagttgacatgagtttgcgatccttcttaactgctatagagtgcaacgcaattgaagagttactttccctgcccagggctcgcgacggagacctgtgcttttcgccaattgactatgcgcctctcgtttttgagtgagctctgtgaggggcgcgaatccttttggagcacccttggcaatgccccccccccccccctccgctattagtccgcggtgcctgcgaccagaagaggccgtagtatctcgtactgcatgttcagcagtgtgagaagtcgtctcactagtccaaggcaggatgcactgagcatcgcaatgcagtaaataaaacatccctgatcatgtttgttttttcttgccgcttgtctttcgtcgtttgccgatcaccatgggacgggtatcaaagttctgaacctcggctaaaggcaagtagatatggtgaagcgtgagcaaatccgcacctccaaaaatattttgggagaaatgggcgagtgtgaaccaagggcgagaaagggacaggacgggcgagatgagaaggagcaaggtatcagtagtcgccctcgatccatcctctgaaccttgactattgttgttgtaggcatgagcatgcaaagttatcatgcacagccacataccatctgcacgctcgtgtagtcgacaaatcgcgccgactgcgcgctgcagtgcaacgcgttcccttgtgctcacacagctcctcaccccttcaagtttcgacatcacgtaacactgctgagctaccgtcctacggtcctaccgtactgaactccacgcgacctgaaactgtcacatcttgaagctactgccggaccccattccggagcgagataacgacgacggtgatgacagaggcacagggcgtactctcagcgtcactcctgtcaatccaggcactatgcgtgttctcaccatgaccctccttttgactatgaacatagcgtgccaacagtgtgccgggaacccactctgcctttcactcattcaccctgcactcactgaagtcctatgaccctgcctccttttcttcgagcacggctcttattatcttctcacattttttattcataataaatattcttctaaaccagactctctgtcaccctgacgactctaaaagtcaccaaggtgtccagggcgcacgacgaggacgtggtctggatcgcgccccagggcggccgaggtcaagagaggctggcccccccccccaacctcggccgcagaataaagtgttagtaggctgttcatgataacagaaacggcgatacatcatagcgtatgggcacacaaatcaaggcaagctaggaaagaaatgcacttacgttgttgggtggggggggttctcctttcctctccactgctctctcaacatcccgccctaccctccttgaacatgctgccgactggtcagcacgttgagttttttagagagggtctctcctcctgccctctccggtttaaagcggcggcgaactcgctgaagtttccgtggtggttagagtgctagccttcactgagttttttaaagtgggtcactccactctcccccttggtgtaaaaagaaccgactgccagtcgggacagcccgttgtattttttagagaggtgcttgtcctcctgccctctccggtttctatagcggcggcgaactcgctcaggttccgtggtggttagagtgctagccttcactgcgttttttagagtggctcactccacgccaaagagggggtcaaagcgagtgcaaactgtcagtgctggtggggatgccggtcaacgagcttcaatccgtgttctctttgtactgtaactaactgcctcttttttcttgtctttcatcccttgagccctcatagcaactgttgtcgcttctcctgtgcgacgagtcgaaaggttggactagttgtgctcgccacctcgttccagcaagctcctgctgtacttgcaacctcacgggaacgagctgctgattaaggctggctactttgcatactcgtcgcactggttcgtcagcattagttgaacagacgtagccttcatagtcaggatcattagtgaggggaggggggtcagtctgcaccatggagaatagaaccatggcggggctggagaggagagcgaggaggggagagggaggagtagcattggtagacgtgaaggtgagtcgtgtagggtcagctagagaatgtggaagtcatgtggcagcggttgcagttgcataggttgagatggaagcgggtgaggaacgggatgcgtggtagtggcgaatgggatgtggaccgtgttaccgggcaactgaagtgagagcgaagttatgagcggtaaagtgagaaggagtgaggcaaagaagaaagagataaagtggacgagggaaaaaaaagaaaatataaaggttggagggcaagggaagatgggttgtgctggctagagtaggggtgagagatgtgaagttcaaggctctgtgggaagtgaggaggattaggagacgatcctgcgtgagtcttggttactgggaacgctgtgagagagatagatgaggagagagacactgatgaaagcgataggattcggaggacagggttaagtagcgttgatcgaggcgggagtggggtggtgaggaggtgaaatgtgcgcaggtgagagcggataggcgtgcagtggggaagagtggctcattatttactgagagatggaaggcgctatgggtttgcgtctgatttaggtcaacgcgatggagcgcgagggacaaggtatgaaggtaggaagcaaagcggcgaaagaggcgagagaggggagcgtgggtgttgttggggcagcttgcgtttgagttagaggcgtccactttggtgggtgggatcggttcggtgatgaggacaggagaggaagtgctggtgagccactgttggttttgactttgagggaggggtgaacgcgataagtaggtaacacgaaagtgttgactgtggatgagcgcagagtagattgcagtgatgatgcaaccattgaaagtaggatgtacgtgagaaagggacagatgagatgtgattgcagacggaagttgagagtccaattcaggagagaaggtgctagttatgccagttgtcgatcagagtcgacgtgaacagtacagtggcgattgagaggagggatcacagcgtggggaggagcgcgaaccaagtcaggcttatgctgtggtgaggttcatcgatagcgaaggaatcacaagagttgacatctcgcattgagcgagaaaggtgaaggtcgattgcgggaccaaagacgctttgtcaagcagtgagccccagcaatcaaaaaaccgctcaagtgttggggagggttagcaagggaaagggctgttgggattgaagacaagccgctctggtgtcggcggaaactgcatcgcagtgttcgcgtgagactgtgagtttacagtgtacggtggcgagagtcagaggaggagggtgtgtgcatggttaaaacagcgaagaatgcaggtcggtcgcgggcgatgttgcctccagccagcctgataatgtatgataaagagcaaaagagagaacgattgcgagcgagaaaggagggcagagtagactatttgcgtgcaaagaaaggggtctgttgtcaacagaataacggctcgctagccttgttggagcgtaaaggagcatatggctttactgcaaagggcttgtctatagcttcgcaggcccatgctggttaagaatgggcacaatgtactccctgtaaccctcgacgacctccgtctggttgatggcctccttctgagcagcatcccacaagcgctgataagcatttccatctgcgcttcctagagcgctgttgagataatggtccgaaaaatcaaaggcatcgaccagacccactgcatcgtccgcaagagactcctggaggtgcttgatttgctggcggagcgactggcattggcttggagagatgaaaaagtcctcgagaaactctcccagagatgcatggatggtgtggagagcatagaggctggaaaggcgttcgagaaccgcaacggattcggatgagagaccttgcttcctagcagcggcgacagagtcgatggccgactttgtcaacacgtactgagagtgggcatggcacagtctccaacactccagattcaaatcactccaggatacaccctcctggagggcagccaagcccaggtccgccaccagtcgaccagcacggtgttcgaatgcagcaagctgaacttggggactgagccaatcagacacatctcggacagcgcacctctcggcctggaaggcatcctgatcaatcgtcttcacgacatactttgagtaggatgtcaccttctccggtgctgtagtggcgagcttgagctgcttgaggaggtagcgtgccgattgttgcgtcagcaagaaattgtcgccctgttcaacaagaaataacataggtcgagtcagcaaaccagaataatcaaagaaaaggaatgttggcggtcggagcaaaaaagctggacagcgcccatcccatacctcataagtgttggatgggacataggtcgaccagacgtgggagataccactaaaatacgagtagccatggccccccatgatcttgcggcagtcctcggttccagtggcagcgatggtggagcaggtgctcttcagtcccgagctgatagcatggacttcggccaacgaggacacgtcgccctccatgagttcggacagcatgctctcatacatagtctgcatcatggagcctgcagcgaacatggcgtacgcagacgcaatccacggaaacaggcgcgactggaccatcgggtagttgatgacttgtgtttccaacgctggattatcagtatccttgcggctagtgggcaccttgaactgacggcgcaccgttgtgtaacgcgtcgcaatggtcgtggcacgcgccaaggtaagagctgcacccctaatcatctgagaccggagcagaaccatggatccataggccagctaacatgtgcacagtcgacaaggagcaacacccgggtcagaatccaaactataagcggcaaggatcacttgacaagtcatggaaaagctccgctagtaccttgctgtgaggaggcttgatgtattgaccatctttagtgaccttggcgaacctcatgagcatgttctctcgaggaatgcggtagttttcgaaccggataacttgagaaagtgaagaaaaggaccaaggcaagacaaaggtggttaaatggcaacgctggcagggacgtacaatccaggtaagagtaggcacgggcttcacttacagccattgtcaatctttgaaaatccaccgtatgccttgggtccgatgtctccaaccttcacaccagggaatgcacgatgatcctttagggagcggataggtacgataaagccatgtgcgccatagtccttgccttcaataatgagacgggcctggataagagcatgggtcgcgatcgcccccagtccaccgatccaccacttggatgctgtgaatgtagtgctatgaatactccactcgtccgtgtctctgttcagcgtggctgtcgtctccaactcggaaaggttgcctacgaagaccaaaaaaaatcgagtttgggtgagtttgtctagtcgttcaatccacaaaagaaagttcttattcaagagcctaaatccatacttccgtgtcccagctccgtctgcgcgtagcagccgatgatctgatgcttctctgctaggggtccccagtacttggcctgctcctctgttccttgcgcatagatgatcgggatgaatgcagtctcgtgaaggccaatctagacaacgagcgagtgggatggcgaaaagacagaggccgttagtgcgatacgcatggataggctccacatacgggctcctgttgcacgtgtaaagcaggttcccatacaggcaagagctcgtccacaaagttcatgcctacgccggatgaaaaaaggtttgcaagagacacgagtggtaagctaaaggttttcttttttctcattctggcgttgacagtgtccatccctaaagcagaacttacacatcaagaaatcgtcctgcgagagtgcatgctcctccttcaactgatacaatcgcaagctcatggccaagccctgtttgacatcttgcactcggctcaggccaattctgtgttgccaaaagaatagagtgcgacatgcgttgacggtaagagcgagcacggattatgagcgggacggagaccaaagagtgaaagaggtcgtgcgtatgtgtgagtgcgaatgagaatgaggagggagagaagaaaaatatccacgcgttgagcaacgagagggaaaaaaaaggcgatgcgccagcgtgggagtgaagctgaatgattcgagagggtttgcagagcatgagcacttgcctggcgtcattgctaaagacagggtcattggcgatcagttgagcgagttctctgcgtcgagcaatcttgtcatccgagccgtgcacgtatcgcgttagctccacgactggaaaggtggccttggaccgagcagccgcaaggtccctggattgttgtgtttgtgccatggaagggaatcgggcaagggcaagcaagagcaacgagagaagtagagatgaggtggtgtggggaggacagagacaaagagagtgcgtgtgtgtgaaagagagaggaaaagagagggagagaaggagcgaaaaagaacaaaggtgggcgttttttaaggtgggctggcccccacaccggctcctccggctcgctttggatttacccgctctgtttgtttgtgatgcagttacacgctacaaggttggacacaaacggtgaaaaagaacaaatccaagagtgcaccggctcgccgagccggctgtcagaggtaggatgtgaagaagaagcgttttaacgttgtcacgaagcgcgatctaccgacagacaacctccgagacgggcgagttcaaccattcctccatctccacacaggctgtcaagggacgatcgtcccctgatccctgcatatccgcatcggatctggcctgagcgagccttgtctgcagggtcaacatgggcacctccaggcgcagttgctgggcgagagactgatcatagttgattggaggaacgttggcccaaagcatcacgcccccagcaggaccgtctatagtacagccgtgagagttatggttaaagtgtgcaccccatgatgacggcgcgagttagttgaagagactacggcaactagaacaggtgcttaccgatgcgatggcgcttgtaatggaacactgcagacgaatagaacatccaaaagtggccattgttctggtctttcagacagtctgagcaaggctgggtgacatggtaccctgcaatttggccgctttagagcgcccagcaagcttagcattagtcgtcatcgtagctatcattcatgttccacaatcgcagcttcacaacagaacctaccagccaaggcaggcgctgtcgcggatgcggcaagcacaatggcggacctgacgatcgtcgttcaccagctgaagccctgctgggggcatatcggtcgagtacagctccttagaatggtcactcagcatcacagccttcatggccctcaaacagagtggtcggatgcaagcggcacaggccagctgatacacgggttgactgaggaaggccggtcgctggtgctgtggtggtgctggtccgtgtggcggttgagcgcgtggctgtctaggatgcccaagctgcaggtcctgctgctgaaagtatctttgttgatgcgcatactgaggcagagcaggatttgtgggctgctgtggcactgtggcatcgttgcggtcgtgttgactctggataatcatggctggtgaagcttgttggggcgccaatagtggcaaccgacgcgtcgacaggtgcgtttgatgtggtatgagagtaggtacgcgtgttgggtgattcgtgagatcctcctcaactcgcgaaaatgcctgggccccggcgttatgccgatcgtgagtgtcatgctgcggacgacgtgaacgctgcggatactgcgaataccccggtcctcgtgagcgatcctgaactaaccgctgctggccatgactgtgagagggtgatgacaggcccataccgcgcgcaaagtcaccgtcctgtgcgccagcatattctctcctcgctaggcctacgccaagctcttcgctctcaaggtgacgagcgacatgtgctggatccagctgctggtttaaatccatagtgcgatacgctctactctctgttgagccttcgcctctctctgaaaagtacgtgggggctgagtgggggctagaaagtgagcttcgagctgcaggatggagagggatatttctattgcttcgggaaggtgtggagggtgctgtggttgatgctatggcgtgctcaatactgacaactgactggtgcagtcgcgggacggacgagtcatggtaggatgccgtattagtttgaaggtcggccaagcgactgaggttacgggtaacatggagcgacctacgcaaaatatgcgagccgtctgagaatgaagaacgcaagtcgcgactgtgggctagggattggctgtgtcccgtgtgctcgtcctcgggatgggccatactatgcgggccaccacaaaaagaaaaagttcgatacgccttgtaaagctgcgtgtgcgcggggcgtgccgtgcactgtccctttagagattggcaaggtcgagttacgaatcaataacagaaaggaaagaatgcagagcaaacacttgaactcaatggcggcaatgaatcgcggctgtaatcgaggatggaggggtcagttgcgaggcaagagaaaagaaaaaaaaaatcgagaaaaaaggcatgttttgccagcctgattccagctcactcttatccgagcctttcattgcagaccgttacacctggatcctacacaacataccgtgtcatcgctgctcacaccatcccatcctctcggaacgcgaccacatcgaggcagtaacacgatttattgccatacgatacaagcatcctgtaactggactctttgtaagtatagagggttggatgggagtgtggacgactatacaactgctgcgtgaactggcgagggagggccatcattcgccgagttgttgccattccgcaaacttgaaggtggcactgacgacgatggctgggatggggacgttgacggctctgatggttgaggcttaacaccccatgcacagtagcaatttacatagcacctatgagtttcgtactccacaaaaatccttctgatcatggcctcatactgcacgtcgttcagatgtgtcaactccttgatccagccctttagacttgaccataggcctgccgagttctccctcatgagctggccaactttagcaccccaggcgcccactgggatagacgcgtgacaggatttgacgtccaaaagaccggcttcacgcagcatcccgtccagcttctttgcgacctttgtgtctagacctttggcgatgcatccctgttcaagaatcgagagtaaccttgccaactctgggccattggcgttggagattaaaggaatctctgtcagctcaatgattcctccaggctttgtaacacgcacaagttcctgaatgacaaacggccagtccttggctagatagcccataatcatgaagcgctgatacacaaagtcgaacgtgtcatcttcgaacgggaggccctgggttgcatccacaacctggaaccggcagttgcgtggccgaatctctgtcggccacacggccgatatgtcgatgcctgtgaaattagtttctgtgtgctcagtcgacatttctaaagtgcgcgcaaaagtaggtttggtaggacgagagttccagagcgcatcgagcaaaagagtcaataatgaaggtgagacgtagaacgcgtgcagtgttgccacctaagaaaacaaaacacaaggattcagtccacttgcctagaatccaagttccagggccacagcccacatccagtacgtccttgtgtatcgagccgtcgaactttgcgcgggtgttgccctcaaacgcgtgacgcacaacgtagtgctgcaaatgaagcctaccgtagcagacagcagacacacaaaaataaaagaggtccgttgttgtcagagaagcactgacacatccatagacaccatgttagagcacgagttttgctctccatgtacctgtccatctcgtcaatgtcgttaggaaggatgtaggctgctccctctacgttatgatggcgcctgccatctatccatcgaaagttttggtggccgttcctggaagcacctgaggacgagtgaagagtgttcgctctctgatgatagaaactttcgttattagcggtcgaggcgatgactgagggtgcctggccattaataccgggaatttgtttgaaatccggagaccgtgcaaaggacgtgctgctctctaatgcctgacgagcagacatgtggtcggccaaccgctggtcgctcaagttcctctgatactgccgctgaagctcttgctgagtcatcctcggcttcttttgcagacgcccctgcaaggaagaatgattgctgcccatgctgtctgtgtgtaaagttgctgcgtaagtctggaaagaggggggtgtctgatggcggggaggaggagtttttttgtggggaagtgaacgttaaaacgggggggggaggtggttggatgacgggatgagaatgcttctatagtactgaagtgaaaataacgacggcatccagtagggggcccaagggagggtatatagcgatggacgagaaagtccactcaccgctgcatgcaaggagcgagggttgaggagcgatcgctgacaaaagaacagaagaaaaaaaaaaaaaggtccgagaactaatagccaaagtcgaaaaaggtcgccgtagagcacagagagcaatcgctttcttgtgcagaaaagtaaaatgctggaggtgggactagggatggcggcttgatcgaggtggagaatggatcgttgccagaatagaataatggacagcgagggaatgagcaaaggcaagtgctggaggggggaacgagtgcggggcaaagaagagaagggaaaaaaagaatttgttgtgcgttgtgcgatattaagcagcacgacgacaacagcacacacaacagcaacaaacaacaagaaatgacaactgtcaccaccacagcgacagggacaccagcaataacaacaaacaaaaaaacaagaaaaaaacggtgagcactgaaagacatgaacaaaaggagctttgtacacttcagctggtattcaagtttgatgatgatgatgatgacgatgataagtccaatgcccaggagaatcgagcccatgtattgaagggtgcccaagatgttgaatctggaatatgtgcagcgagtggccattgtgtgtggtttccttttgccctccgcatgcaggcaatgcaggcagaggagcgtgtgcgcatcgcagctcgggccctctaggttttagcgatatataacaataagagcaggccggtattcaacaaccgttatagttttgttggccgtcttttcctcgggtcggtcctgtgaggtagcagcacagcaggggtccgccgatgtgaggtgcatgtgcggcgccggaccgcaattgaggatctgagaaattcccgccaattttttcacacggcccgcggagcagtgaagcatacaaatgctatagataaagaacggcctcccggcagcactttcagtgacaagctcatctacacccatgcactgcagtcagggtttcgtagtcatcatctcctacagcacctcatgattgcgctccgcccgagggtcaatctaccgcacgtaaagtacatgcgtttgactccgctcgtttctcgctctcgtcagcataggctctaatattaacgattagggttgcggtcctctagagtagtcatcggctcccctagtacttaacctcgcgaggtcattcatttctgaccccatgcccactatcgcggtcgtatcgaggatacttttaatccttaaagaaaaaggaaaaaaaaaaagaagaaaaaaaaaaaaaaaaaaagacaaaaaagaaataaaaaaaaagatggaacaaaaaaaaaaaagggcagcgttacactgctggcggccagttgttgtcgctggtataggcatataccacatacatgctggtgtttttggcgtatcgttcgagatagtaggcgaccaccgttgatcgaatggctaccactgttccaggacgcatcaccaccctcttaccaagttgaggaatgcatagatcccctccaacaaagtcgccacaagccacgatccagcagaacccgtgctttgtatgagcgctgtcatggtgaaggcgtggagccacgtccatggccaatgctacagtggccactgcgtcaaagaggcgaggggttccaaactgcagaccgtgatacttttcgtacagcgtcggaaaaagatacttgagatgccgtgcgatgatgcccttctccaccatctgaagtgctctgatgagtcgcagtagccttccctgagtagatgtctccaagtgcgtatcctgatgaccccggtcgtgttcgctcaggccgcatctagagctatcagagtgaccatcgcaaaacgcatcctgattgtcatggtgcagggtttggtttgaaggcgactcacacgctaagcgaggctgatgggcggaatgtggctcaggatcatgtccgtgttggtgcgtatgtgtagttatctgatctttcgaaggggcgaaagcggcactcggcgagacattcatgttgactgtagatcccaagacggatccgcctcccgcagccagcgtcaagggcgtctggaatggaggctgtaaaggaaataaaggttggtgtcagagcacacctaaatacccttccgcaacagcacaaagggtttcgtgaacatcagcttcttacatagaggtgagatccttgctcgacaggtgctttaacacgccagtgaccaaagcgaagcacgcccgtctggtgaggttgcttccaggaaggccgccatccattcaaaaagccatcgccgctgtgcccgcgtacaatgtcgttgtcctgaaaatcgcgacaacaagcttcaagtttcttcaaaagagcggtatcaaggctcgagggcggccaaacgtgaagaagcacctgtcgagaattgccctcggctgactgaaactcatgaaactctcccacaggttctaggaactcgctggttttgcgtccgaatttgtatggtgcgttcgggggtaatgggtataatatggctggcggtggtggtgttgtgccgcgatacatgtgtcgtattggaacaggctccagcgtttcctgctctcctaatgttcggccaaccgtgtggctacagtgaatataggcatcggaaagtaagatagggaaaatcctggaaattagaatacactccatggttcaggtacacagattgaaaacaggtctccacagcaagcagtggattctaacctgttaatagtcggaccctgtccattgactgtgattttcgcgtgctgcaggctcttgctactacgagcggacacaacggcgggccgttgtaggaactcactgtgtcgaaaggctctttgaagagacaaaataccgccctcttcgtcctccattcctgggtgctgccgaacgctaaaactggcaatggctgcagccgctgttgcaagagcctctattatcaaaggccgccatgcccatccttgtctttccaagcaaagtgtggattttggttcgccgcatagctcgcacacgtatcctgctgtctgctggttaaaggccggcaaatgatgatccaagtgggaatggtaaggttcctcgactggattggctagttcgccctcattaaccgtatatacgtcgcaaggggtcatatccttgtaatcggcgtttgacgactgaggcagtagcgagccttgccgctgcagttgctgttgcagttggcgaacgttctcctcaaactcgacctgctcgcgccgcaactccatgaggattgcttcctgcgaggatagaaattcatcatgctcgtagacatctagctcctcatcaaaatcctcgcagtcaccatcgtctccgtgatcgtcgtagctgtccgcgtcctcatagtcaaggtcgtccgattcagaagatgaattcggcggaaactcaccaggatgctgttgaccaaaatgcatcctgccttgaacctgcttgacggacacagcgctggcgtccatattagatagatttgagtagagtgcctcaatgtactctgtttccatggaggtcgaggtcaaaaatctcctgtcgacccttgaacgtccatcatcctcttctgcattgtgtttgattagtgagggttcgacaccattactgtggcgaggatgagactgatgtggcgtgtacggtgccgtgtgtcgggctgagggtccttctcccgctgacgctactggcaatgaaccgatggatgcacttgatgttgggacagcttgtggtattgttgcggatcttgactctattgtaggccgatgttgctctagttccggccgatcctgatctttaagatgagcttcttgagaggtctttgtcaactccgtgacactggaacctgtaccaatggctttatgggagtgaccgttggcggatttctttaatcctttccttgtcttgggcttcatgggatctagggtagcaggaccagaatcaagcccggtggcattttggattactctctgcgggacaggccggaacgtgattgagcagcagatactggatggatggaggtacgaacgtagcaacataccgtgagtgagagcaagcgcatccaaaagctgagcaaagctgaaaggcgggcgtgggaaggatgagtgtcagaacacgaaaaatagatcggtgaaaagaaggaagacaggcgctttttttttttttttgtaatgtatcgcggtgtccactatgcctctgggcctgcataactgaaatctttttctttcacgtatggcccctttgcgtttatgaggggcgctggttgaacgtgcccacatgccccgaggcacgcgtggcaaggtgccgctcattttttcgactcttgcacctcttggccttttccacctccattcgtcccctgacgcgcaagatctcttcctgaatccgacagtctctctccgtctctgtctccctctctcatcactcgctcgctcttcccccttcctgccgccgcctgctcaacctcggctccttccagaaattcgctcaccgcagctggcaattgcccattcccgtcaagctcgtcgcagttgagcaaacaacgccctatcgccgccaccgcgtatgctgctgcagtttcatccttgggcctcggccgtggaggcgccgttttggcaggttctcacacagcgcaagatggacatcttcaagcttgatgactcccacaaggccgtgctgggatactactctacaggccagcaagtccgcgttccaggaaaagacacgacgatagccctgcctgcgcgtctgtgcctcggcacaggcgcctttcctgatgagcaggatgctgagcatgttcacacaaggcaagtatatgttgtataagcacttgtccatgcttttccttgaagtgcatggaaggcggttccctcgagctaattcgcgtttttcacttttaaccttttttttttatctacagaaaccccgccttcacgttccctgctcctggtatcatcaaaaacacgaacacgatcgaagactttaaggctattgacaagacagcgcttttcaagatggttgttgaccaggtactggaccttttgcagttttgcaactgggtgtgcggatttcagtcttcatgatggctaacatttattttgaaatagatctgggatgatatcacctcgggaagggcggtgtcagaccccatgcttctcaacagattccttttgctgacctttgcagacctgaaaaagttcaagttctattactggttcgctttccctgccctgcaagctgaacctgcctggacgacagagcctgcacaggaactggtctccgtctggtcatcgccacaggtcagcagcctgctccaccaatacgatctcttccgtcaaacccatccgcctggccagtggggatttttcctggtcaaggagacaaatgatgctgtttctgtggcacgccttcaggattggaacgagttttatgcaggatgcgacgataacgaggtacggtgcaaaaaaaaacgaagaaacacggggggctgaagcctagcgacccagtgaggtgcattcataaggggtatggtttttttacaacatctttttcttcccgtcttttggtctgtatagatcattgtcgggtttgcggatccatcttcgctggatagtcaccctggctggcccctcagaaaccttcttgcgttgatccagtatcactggcaaaaaaccaagatccgcgttctatgctttcgagaagtccctgggaagcaagacattcaagctagcaagtttttcaccgtacacttgccgtcccagcagccgctaaccagtaagcatgactcgctttcagtgttgctgcacctgatatgcgcgtggctagtcgtgggccctgctgagcgcgactgactatgcctctcgcacacatttagcctgcccaaaggccgttggatgggaaaagaatgcacaatcgaaactcggcccccgtttagcagatctcgctccattgatggatccagcacgcttggcggacactgctgtggacttgaacctcaaacttatgcgatggagactattgccgggtttgcaactcgaaaaggtgcagaatacccgctgtcttcttttaggtgcgggcactctgggctgctacgtcgcccgatccctgctgggctggggcatccgtaacatcacatttgttgatagtgcaaaggtttcattctcgaacccagtgcgccagccgctgtttgcattcgaggactgtcttgagggtggcaaggacaaggctaccactgcagcagcaagccttcgaaaagtatacccaggcgtggtaagtcttcgaactcttcgctgttgaaaatcgccttgtatgcgtcgtcgaagtggtactttcaaagagtatttctaaagataattgtctttactgccattattagaatgcccaaggctacacaatgtccatccctatgcccggccaccctgttagcgctcaactttatgagagtgcgcaaaaggatgtcgccaaactagtggagctatttgagcagcatgatgctgtatttcttctgatggacagcagagagagccgctggcttcctacactgttgggagcaaggatgaaaaaggtcagcaaatagggtgtgaggaggtggacctttgacgcaactgaccagttaggatcactcacatggcatgcactttcacttttagatcgttatcaacgcagcacttggattcgacacatttctggtgatgcgccacggcgtcggtcaggatcacgagcaccattcggtagctagctccacgcctctaggatgttacttttgcaatgatgtggtcgcaccaacagatgtgagtgattccgaggtctacaagctatcgcacacgtgaaacgatggcaatcatcggatcggtactaaagctgctcgcctattgtcgtcacggacacccagtctctttcggataggactttggatcagcagtgcacggtcacaagaccaggcctctcagccatcgcgagtgcaatggctgtggagatgatggtctccctcctgcaccatcccttggggtatgtgcactttatttctaaatcgacacgatagtcccgcttttcaagtaaacgaccgctgatcgcatgagtgcatcttttgcttacgtgaacttttagggtgcgcgctcctgccgacaaggcggatggtgatggagatcaggacgctaacatgctggatgatcagggctcgacattgggacttctgccccatcagatccgcggcttcttgtcgcgtttcaagaacctgctgatatcggggcaagcctacgatcgatgcacagcctgctcggaccaggtgctcgaagcctatgagcaggaaggctttgggtttcttgtcaaagtcttccaggacgcaaagtatctggaggatattacgggtctgacaaaaatgaaggaggagagcgaagctctagatatggaatgggcggaggactctgacgaggacgacgatatgtaaaatgtgattcaagcgaataaaaacgccgccgtaactttttctttttctcctcgctcgtctctcaacctcacttccattccgcccaccagccattccatggcgcatccccgctgcacgctgcaactctaacttgtttgattcgcattcccttggccgtggcatggacttcatctctcctgcagctctccgaaaagtcactcgtgagctgtacgcgctggaaaatgatccaccagagggtattcggctgattttgaatgaagactctatgacagacattcaggcgtggatccaaggtccaggtaggcaagcgggtcgtgtcgttaatgctcaagtctgttcgctacaaagcatgccttaatactcgcgtccttgcatccccgttcctgtgacctttcaaccgcccttaccgtagagggcaccccatacgacggtggttgctttaggttgcggatccagctgagtgccgattttcccaactcgcctccaaaatgtacgcgcaagtaacagcactactatcgaaggagatcatgcactgtgcggctatagcgttctttgatgactgacaggagaccaactctttcacctgtaggctatttcatgaccaagatatttcatccaaatgtctcgaagcaaggcgacgtttgtgtcagcaccctcaaaaaggactggaagaaggaccttgggcttcggcatatccttttggtgcgtgttacaagacttgagctagtatgccccctggtcttgaggtgcatgcgtggaattgtcgttctcatgagcttcttcttttctacttgcaggtcgtaaaatgtctcctgattgtgcccaatccagagtcggcattgaatgaggaagcaggacgccagcttttagagcgctacgacgattacgccaaatatgctcgactgatgaccagcattcatgccgcctccgctgggcaaagtaatttcgcactaccatcgcaagattgtaacacttcccatgttgagggtccaagctcagaaccactgcacgacaaagaggacgcagacggcgacccagcaggcgaagccaatcgcgatgccgtatcgaccgattttgagctcaccaagtgtagtgtagcagacgcggctcgagccagttcacgagctgtagcagatggccagtctaacttaagctcggagccgagtggtgagcggacaggcatgtttccaaggagcggtgcaagttctattcagggacaggccatcggcaagaggaaaatggcttcagaagacaagcatttagaacaggatgctggcacagggtcaggagctcagcactggcgacaatcagaggggcctcatcgccctactggcactctgcgacacctgggaggaacagcgttgtccaaaaatcagcctctccccagtattcacgctcgacaaacgttactgggaccgatagcccaccagaaccttgcccaaaacctcgctcaccacaaacctggcgctcctgatcaacagtgcaaggatgatacccagcaagttggccatgcgaccgcgagagcgtccattgtgcctgccacagaagaaggcacggccctgcatccgaagattgtttccaagtccccatttgcttcgtactacgggcatagtcagtgtggcgcatcgctcattcatcctgcaatgcccccgtcgtcctcttctacgccttatagtctagacagtaataactctcacgcccattcgaacaaaaaacgcgctctcaggcgtctttagtgagataaaaatgataattgccataccatacttacaattcgtccactcctccacacccgaaacaaacgctataacaactctcatgactctttcatccaaggagaacacttaaagcaaaaaaacccatatgtctgtcccacaagtaccttatagagaacgcgttcgtagtgcgctacgccacgactttagcaccgtctctgggcggataaagtcgcgttggtatcaatgtcgccggccgcgcacgcgctcaactgttggctgcttaactgctctccttgaccatggaggatgatgtctgccttccttggtcacccagcttgtacgtgaaatggttgcagccgttccataggtgtttaagacaccagtgcttgtctgtcgctgatcgcacgaaagcagtaaaaaatgcagcatgtaacaatccgcgtgctgcgcgtggaggtcagcgactaccaacatgcaaaaagaaggatatccaaaaagaaacaagaaagctcattcattcattcttggttgcgaagataggaacaacatatatacacgggggggtgtaacgttatatacacggaggggtgtatataaggtcatggagggtgtatacaacacggaaaacctgtatacacggggggtgtatggctgaatacacgggagggtgtatagaagcgtatttcagagaatgatcgttacatgcacacacacaccgctattttttttctttcacctatagcatgcctacatgtaaccagctatcagagtgaatacgagcctggatgactcctacatcgggtgccacgagtacccacgccatgggcagcagagacagagtacaccttgccattcacaccgccaatcgttgcgcgaaactgttacgattggcgaaaagcacacgagcaacgatgcaagtggggcaaaaacatattgcatgattcatgaaaacgggagctgggatagagctacagaggtgagcggcgataaaagatgataaacgcgcacagtacatgtttacaccgcatggcgatccagccacgctaaacatccatccgcccgtcaaccagtcatccacactgccagcgagtcagcgagtcaggcagaccctttagtcactcagtcgttgcttgtggacgtgcatgcaccccccccgccatgtcatgtttccagcatagagaaataacacaggagtagcaagcggacgcatgggtgtggagcgaggctgtgagactggctgaccaccctttttttttgttgcgctgtttccagggagcggtgttagggtgcgatgatgctgctggtgatgcgttttgagctgatcccattcctgaggcacgtcttgttgcagcggcgtctttttcctttgtttctttttcctctcttttctcctgtcttctcttgtctttttcttttctcctctttcctctctgacttgaatcctctttgcttcctgtttctgttcttcctgttacgctcctactctgcttctctttgcctgctagcgccctcctctgccttcatgcatccttcgccttcacgatccttctcaacttagcggtagcactgattgatgagggaagttgtgacatgcagaggctacgtctctcatacgattgtccgctcggaccaactctttctagtttcagtaacagttccaacatatagaaaaacgccagagagagtggctgggtgtgtatttgacgagccttctctaaaatttgcttgtgtacaccctcccgtgtatatatgttgttccggctagaaaagcaaaagattattgcgtggtccgggaatcgaacccgggtctaccgcgtggcaggcggtaattataccactaaaccaaccacgcatttaaaattcgagcctaaaattaaatcatcaacacccggacaatttatcgtcaattacataaatatttgtcaattacgaagggttgagaaatcccgtgacttatcctggccgtttttttttttcttttttttggaggcatgtggaggacgaggagtggcaccgccagtatgctggtcaccgagaagctcttgtgcaaatgagtctggaaaggaagaggcgaatcctcttcgttcagtcaaaacttggctctattaaaactgtaaagtcgtgccggcagctatcatagaatgggaatcattttctgacaaactgaacatcctcttgactttcaacggcgcccgcgcggatagttttgcctttgatccactctaaaccttcacccgcatagctcataagcggactgatctcgaatccaaccctgataggctctgtggatccattcgctttcgagaggtgatccgcgtcctcgccttgaacgtgcccgcctgcctcttcgatccaccggatatgcagccgctccaagtcgcgtcgcgatgtctgaggcgagtccagtccactggcattcttcatgggcgaaaactctctagatcgctccacttctaaacacgcaaagcgctctgccaatggatagacgtcaaacacaaagagctccagtttcacaccgttgggctggtcaggactaatgcgatggccagtcttgagatcgacgtagggaatctttttagaggctagatggtagatcagcaagtcctgttctttgtccttgagtacctctggcaccttttgaagaaacttgagcgagcaaatttgattgcagatatttcctgcgcggtacacaaattctcctgtctgtggatcgacgagtgctgcaaggttggggtccatctctgaatactctaccaccttgatctttcccgccagtcggcagatcacgcccaagggttcggtcgccatggtcttgggcatcaccttgacggtcacatccgctccttcctgcaaagcgtggccgatggcgatggggtcgccaactttgatcaggatgttgtcgacagagtagctgtgtgcataccggatcccacgcctctgcagttcatccagtacaccctccttgtgcatagcccaatacaggccaccgttcccgttgggcgaagttgcaatcatattcttgtggttcaaaagaaacttgccctgctggtcaaagcacgggatcacgccttgctcaaagatgatgatgttgtcgaccgagagcccaaagtagttgtgctctttcaaaaactcttcagtatggtggcgtgttggtccggaggtcatgatgcaccatgggatgataacgggtgggacggactgtacggactgttgcgttgtccttgccttatgtattcttgccagatcctgaagtttctgaatgcgctctgcctgcagctgaaagagtgtcttgtgtgaaggaaggccaaggttgcggtagcagcccttgggaaggagggagcctagccgcgtaccttgtcctcccgccagcaggacgacagcgacctggttatcggctatagcctgcaggcccaaggagtaccactggtccctttgctgctgtgtagctgtgagggtggacttgacttcagccttgtccagcggcgcgagatcgttgaatatggacgtgttcttggtcgcggcgatcgcctgggcgtaaacagagttgagagcggcggggtcgagcgattcgagctgcagcaggaactgctcctgctcctgttgcgtgagttcgtgccagaaggcgaagacgtggtcctgccctgctgctgtgtactgctgtcgcacagcgtctacctttgctgtgtcgagtgccatggtgaagcgatgaggatgaggtgcagccaagtgtgggaggaatgcagaaggcgtgggtgtggctgtggcgtgcagcagacaggcggaaaaaaaaatcggtacgttatggagcgcgcattatatctcatatgattgagaggtctcaggcacagcaaccaccacggggtgtgttattccccgtacagtcgtcattagactattgtcaccgtgctttgctcctccatggcactgggcctcatggccacatgacagcatcagtatgcaggacaaggcaggacacattgcacgcgcaagagcgccgccagacggcgctcgggcacgtctgcgctgccttgctgcatcgcccacatgaccccacctgtggggtcatggcaccgaaaaaatgtgtgaggtccattcaagtgattgagagcgtgagtgcgatgccttttccttgtgtgtccagctccttgggcctcgctttctttttattctccatggctcaattgctccaaaaataatatccttgttgtgctccggccgggacaaacaaaaaacaaaacagcgctgctgctcacttggagagcgaggacagcccgtccgttgagttcatgggctggccacgaggggggaacatgcccaaggtatcgcactcttgccctctttttgttttttatttctcgctcatttctcactctttccctgtctttcttttcgtctgtctattctcctcgcaccgcaccccctcctcctcctccgactcctgcctggacgcctaccacagtccaacaagaacacaatccctcctccacaaagtagcgcccacactcacctttcgttcacttctcaacaaataaagagccgccttctcttcccaccttccctttccatcctgccctgatacccattcaacccaactgcaccacaacaagatgaccttctcgtcacacgaggatgaagaacatgacgaggtaagggattcaatgcatcggtccaggaacgtggccaatgggggacgcagtagacagaggtagtcacagcagacgcgcgcctgtctatcgctgctgtccgtgctttgcgacacgagttttttttccgcgcatgaaaaaaaccacttgcaccaccactgcatacataccacatacacagaacgaagccgcgctcctagactcatcgtgacttacgtccatccgtgttgctcatttgcgaaatgcgtatgatgccattaggtcctgatctcaactatgcgatcacttgatctagccaacagggtaagttcctgaaggaaaaaaaaaaatactgcctgtcactggacacgtcctcgttcaggagagcaggagacaagtagcacggactagggcaagggcaacaggccggcccatctgtccagcgcagtggtctggcggataagagggcgtgcagtaaggattagggcgggaaaggaggtgctgtagagcaggacactgcctccttttttttccacccttctcttcttcctctgctccctcgttatttttttgcgccttgcctccatcgcccacgcagcattcctagtacgatcgtccctcccaccagaaaaatccatcagccatcagccccgcatcgatctcatagacaacagcccagatatgagcgtacgcctgacaaagcacgggggtccctccaccgcacattacccaccgactattttcgaatctgaatcctccagttcactactgggccctcttttgcccaccacgagagcgagtggatcgccacggccactctccagcggctcgttcttcagcacagcttgttcaatcgagtcgttccgccacctctgccaggaccaggattcactgcagcatacgcagcaacacagccagctttggacgggcactaccacagcagaattgctaaaagaaaaccttgcccttgttcagaaaactgcattagctcagcaggaagtcacctcggtccgaaacaaccaggctagactcgaaaaccaagtgtacgagctcgaccagaagctggccgaggcgcgcaaggagaaccaccgactctcgcgggcaaagaaggattttgaccggcaattggatcagagcaagaccgcgttcgagaaggaacgttcgctttggtccgagcgcgagaccgagttggtgcgcagtgtcaaatttgcgacacggcctctcattgttcaagcgccaccaaaaggtaacgacgacgtgaaaaaacaaaaaacgtgaggggaatgagaatgtctcgttgggtgtggtggtacaggagaccactacaacgtctgcagtccaagagttgcctctgttcatgctcagggctcacaactgtgcacccctgatggtcatccaccttggagcaacggcactaacgatcttcttttactttatcaccgtcttataattgggaaaaaaagacgaatatgacccagagagagacccagccgatgctcttcctccgcagattcaacagcagatagccgagaacaatgcagcccacgcaagagcaatgagagcacacgaaaagttagtgaaagagcttcgagaccaaatcttgcacatgaaccaggaccttcaggaacgccagcggagctttcttttacagcggtctgagctccagtcagagattgcgcaagcgcgcgagcttaacaagaacctgatggaggagaacgaaagcttccaaatgctgctgcacgaaaagtctatgaacggcgagtttatgcaaacagacatcatgaaggtaggcagaatggaatagggtttctgttggctttcacaattttcgcccgtactcacactctatttttttcatctactgatagaatacgggctacgatgatgatctcacgggcacacccctgggagcacgcaccactggatccatcaaccttgcagacgaactgggcaaggcattcgagcgttcaccggccccgtcaacagatcgatcgatcgagtccttgacagaggagctcaagacgctcaaggagagcaacactgcactgggactctacatttccaagattctctcccgcatcatggaaaacccccacctccaggccatccttgcggcagactacagccctcggagacagtttgtgcccgagtccccagccgctgtcattacgcaggtcagcaggagcaatggtggcgtgagcggcaacaacagcggctcagaagtcgatgtgaagagagatttcaagaagccagagatgggtcgtgctcgttcacggtcgctgttctctggtggttctgtcttttccctgcgctccaagccctcgcaaccaccacccgcaccgtcctcgaggagttccaacagaagcagttctgaagacgacgcagccagcggcacctccacaggactgacttcgttccaagagggacatatcgtggaggactcacctcgtaccagtcattcttcctcagatttcgccattgtcgccaatgatcactaccatcccgtcccagcagaatacgaacagttgacgacctttgatcagccgtacacgcgcaaacagctccagcggcatgcttccatgggagcgcacgagcgtccccagcggaggcagactgtcggtggtctggtgggttcacaggccatgagcggaggtcatggccgcttcggaagtgagtctagtgctttgcagtcgaccccgagcaggcgatcgatgatggccaagaccaagaacaacctgacggttcttgaacctatgcccgaatcctccaactcgatctcatcccttgcagagacgccagcgattccagagggtcaggcgaacgaggcggagagcaacttggagtcgacgatgaggtcaccgacgctttccatcgcgacatccgagatcagtgccaagagtggcagcagcagtagtagcagcagcagcagctccacgacaactgtggagggtacaccgaccacaccggttgtggccgagggtggggtgtggcgaaaggcgatccgacggatgagtttgtttggaaactcgaacccggtcctgcctgcagtcaagccagagagcgacgcgccatcaccaccagaggaggctcgagtggaggccgtttagaaaagggctcgccacgagaaataactacaaaggttatgtttactttataaaatacaaaataaccgtatccacagcaaggcgatcatcgactgaagaagaggaggataaaggtttactatctgccgcccaggcatggttagtataccatgcccgaggggatatcccatgatatctttcggagtctcgtcaagtgaagaagggaggctgcaatgccgttccgttagttcagctgcttgacaaaagtggagttacgaccacaaatacgattatgctggtcacttcctgtccttgcggcaccaactgtcagtcaacagggaaacaagataaataataaacgaattgaacaagatgatgaacagggagggtgacaagagtatgggattttgaaatggagacaaggaattattgggatgaacaaaagacaagatgcttggtggtggagtaggggcacagcaaattgagagaagcggtcaccttttttttcgatacataggcggtagaaaaaaacaaaaaggtggtcctctcaatctcacacacacccaccttcaagtaattcagaacccaatggacacacagcggaatcccgtgccagagagcaacatggtcaagaccgaagaggtcattgacgcttctgccgaggaggtggccaaaagtcaggagctgatgcaagctgtcgccgagggaaaggtcgacaaggtcgagcagctgctcaaggacggtgccaaccacaggtgagcttaggggacagggacagggacagggacaggggacaggggacaggggacaggggacagggggacaggacgtcaaaagcgctagcataccacgggaaaagacagcaaccctgaactgaccatcttcttttaattcatagtgcccgtgcagctcacggaaggacgatgctgcattttgcgaccatgatcggcagtctttccatcgtcaagctgctgttgagctatgggcatccctggaacctggtcgacgacgattacaagtccgtgggagattatgccaaatccttcaatcagcccgagatctacgactttttgctggaggagggtgtccgtgtagagctcctgatgggtctcatgcagcggaaactcaaactggagctcctcgaggccgcggaggatgatgacgaagatgacgaagaagaggaggaaaacaataagacagcagagcagacaaaggaagccggcaaggataccacggacgactctacaccagccaatgaatcatcagcatccaaggagactggatcagaatccgagccagcaactaaaaagcaaaaagtggagcaaatgcccgaggtgcccaacgccgaatacctcgcacagcctcttcagtacacagaggatggcgatcgcctgctggatgccgagaagaacggagtcatgatgggatgggaactgccattgatggtccgccacgcggaggtgatctctccagaggagggacttcgagtcctcaacgtaggcttcggactcggattggtcgacaaggaactccagaagcgttcgcccgcacagcatacgattatcgaggcccatccagatgtctatgcccacatgatcaaggagggttgggaccaaaagcccggcgtcaagatcttgtttggccggtggcaggatgtggtcgatcagctcgaggtctacgacggcatctttttcgacacctttggcgagtactatgaggatctgagggcctttcacgagattgtgcccaaccacctggaggagggcggcatctactcgtacttcaatggcctcggcgcaacaaaccagttcttccacgcagtgtataacaggatttcggaactggaactgagcgagatgggtttcacggtcgagtatgaggaaatggatattgggttgaaggaggaggagtggaacggcgtcaagcgcgcatactggactctagacaagtattatctccccatctgtcgtcttgacggattttagatatcaggtataaaaacatcaatgtataagaatcgcttttatgtgaaaaaaactctcttctagtcgtccgacggcatcatggggttggcgtcgttgggcgtctcgtggtcgtgtcggcactcttcccatgcactcatcttgtacagcatcacgaccatcaaaaagtggagccccatcgtgtaggcgacaagcatgctcctcgtccacttgttcgtcagtacgagccgactcatcgtcagcattgccttgtctgcaggcgtcatgctgttgaatcggcggctctcttccttcttgtggaacgcttcgaacgggttcatgctctcctcgtaaatgttgcggtaccggtccgttggatccaggggctgcatctgcaccgtctcatgatctccatcgtcctttttgtactgccctcctgcaccggcagattggcggcctactactcctccgctcctgaacggcgatgtgtaatcgaccatggccgcagatgctcccgctccaacgcccgctcccgaggaatcattccgatatgactgcatgtacttgaccttctcgtatagctttaagttgtccttttgcagttgactggtttcgttcctcaggttggagatctgctcagactgctggcgaagttgctcctccagctcgctgttcctctgacggaatcggtcgcgttgactcgtcacgatgggtaaaatactatggtccgctgaggaagtcgccacgcctgatccagcattcggagtgatgttgcctccaggcgtagccaaatcaggattaagagacgccgcagacgtgaatcctggtgttcggggagttcctgcgagcactgggcccaacgtgacgcctcccaccacctctcccgagaatgagagctttccgaacggaggcggcgaggttgggtgctgatggccgctaggaccgcctacaaaatacccattgacgctaccactccccactccagctcccgcggttcctgaagactgatttaggcgcgtgatgtcttcctccagtttctggatcagttccatttgggatcccagctgacgcgccgctacctcatggcgggtccggacatcctccaaatcgttggtgacagactcatgaaggaccttgagttccgttagctcgttctccaacttgcggttcttttctaccaacaaaacttccagtggtttctccaggttcttgctcgcaagggtgagcacacgctcgtcccaatcgtcctctgcatccgctcctcgagatcctgaaaactcaatgtactagtggcacgaagaaaatgtgttattcggggataaacgtattttttttcatataaccagttcgcatgatctcaatttgttaccttcagaacctccagttcgctcttcaccgtttcatagtccttgtattgctcgagtttgcgcttcagcgtctcagcttcttctgtcttttcctggacatctctctgaagcgtggctgccttgcgctccaatgattgtatttgtgtctattaatcaacgtggaggattagcaggatgaatgcaatggtaatgactgcttaatatcagtgggccttgtgcctcaccttggttgaggatttgatcgtctccagggcatttgtcaatgcctgcagttctgcatcctggttttcaatagtttgctcaagggtagcggccctatgtgaggggtatgaatgcaatatctcaaattagaccatgctccctaagcgacgtcctgactctttcaattcgatatcatggctgaaatgacaaaaattacctttcgctgtcgatgtttcgtccagtcattccttccagctgacctcgcagcagctcattttgaccttcaagctccgatatcctgctgttcgcacgctcataatccagtagcacaatgtccaactctgccagtttcgccacgacctcctcctcatacttttgagagtggtcaacaagggttgcctgtgtcgagtcgttggtgtgcttcaatgccttgagttggtcctttgcctgattgagctgacgttgcaaatcgtgctctctaataaggcagcaatgtgtgatgcgtggtaagttggttgttccgcgtttgatgtcgttctcctcatctcccgacgcgttcatcgtaagactgatacgttaagcgtggcaaggtagcttttacctttctttggcgcttcttattttttcctcccattcttctctgaatgcctgctctttctccttgaccttttcttgaatggtctcttcctgcttagtctccaagcgtgtgaggcgttgttgaagtttcgtcgtattgctggacatagatcgtagattcgccgcctgcttgttgagactgctattctcttccttcagccgcgcgttctctgcctgaagtgcgttgatctcgtccagtttagtggtttgatcctaggcaagaaaggccagtgacgagaaggagtgatacagaggtaggaaggtaggtcagattagaccacgcactgtctttcggatcccagctccataggccgtgaggaagcaaacgattaagaaaggcaatgtatggctaagcttaccacagcgacctggaggagttttgcaggatctggtgcctggcctaacgcattatacacgctcaggaacgcctgcgctgtggccttctccctcttggtaatagagtcgatttctccttgatacgccctgagaagtagcttgaactgctgcagtttttcctggtccggtacctttttgaactctaccagagggcaggatattagaggggcctgggcggtaagttgatcctatgctggactcgcttgaacccaacgccggggcatccgtaggaatgtctggacagggccaatttgttgcttacctcgtgtgagttccgcaagtttctttcgccctgccaaactctgttgttgttgctccagcagctcaactgactgattatccatttcttgttggatcactgggagctggatgcctagaattccgataaaagtgtcaggcatgagattgcgttttcattgtagctcctagtttccaagctatgagggcgagtcgatggcagatgaggaaaaaattacctctccaggcagagacagcagccgcaaatgcatcctcttcctccttgagtgcctctgtctttgagctcgattcatttgcctcggcagctgagtggacaccagcttcgcctagaaagtcaaacgccgcgtcggccatggttgagaggggcaatgtcgatttagggtgttgtcagcgcgtcctgagggtggaatgcacgtctcccactccaagttttagaaaagtgcagagttgaagaggacagaagtattaagccgcccttgtctggcgctccaagttcgtgtcgtgtcgtgtcgtgtcgtgtgtcgctgatgatgcgaaacgaaggagcagggcgttggcaatgcacaaagggcaactcgaaggtaaaatctgcgtacgtgtacgtgagattgtgcccatgggatacacttgcttttgtgtgctcgaggctcgcggcacacacggtacgagaggatgcagtcttgcccgtgatcctctagtcagcactgttgtaggctctgaaggctgcacagacgccatgatcttccactatacagtatgaaaaagacgttgggccttagctcgtgttgttcgtttgaaggtgtctttctcagtgtgcagtttcccgcatcaaaggtgctggaagtcactctagactagccatggaagaagcgtgggagtcaaagtgagaaaggggatgcaaaggaggcccttgcttagagagcatttaccggagatgcagcggggtcttttttcaacgaccaggcttttgagggagggccaatcgcatccaggcccaagggaagagactcatttctgcatggtgagggtctatcgagatgcagaaaaggacgccaacaagagcgcatcatcgcatgcacagtgtccagttttccttctcttttcgcgttcatgcgaggacgggtcgacaggcgtttttttctatcttgcaaaagatgattacgtgtggatattttagctagcgtatttttgcgagacatccaacaggtgccccagggtgcaaaagaagggttcgcagctttaccgacagaaatccggcagcaatgataggaactaaaaagaagaaggactcgggcttgccattggctttgcagggatggctgacggtcgttagcaagggcggaagccgtgcggatggtgctctcatcgtgttgctctcaacatgaaatcacttgtcatcatatcgaaacgacccgcaagattaccaaagtgtattctcgaagtcgaagcgttcccgcctgtggtttgggttcccattttttaagaggacgacggggttgtggtcattgcattcaactttcaaaaacccatttctcgcctctccgttcctttttttcctttctttttttccttcttcaccctcactctctcttcctctcacttcccactgtctctccccacacagcgaagaagagttagaagccgcccccttcacacctcgcgttctcataccctttcttctcgcgtcgtgtaacagcctcacaacgtcactgcgctcctcctcctcccttcccacgtccttatctcctcatgcctagagattcggctcgcgagcctctgctcgggcaccaaaatggatccaaccagggcaactctgcctcgggcggctttggcctcacggtcgacgacctcgctcccctgacggaccccaccaaccctaccctgccgcgtcaaatgggcggttctgccaagatctgcgagggtctccgtgtggaccccaaggttggtctgcactctgacgaggctggcccgaactcgaccggccactctgacgagcccaagtttgccgcccgatccaaggcttttggtcgcaacgtaagcatcatgaattttttttgttgctgttacccaccttttgatttccggtttcagggacagggagtggatttcattttatctcgttaagggaaaaactcgttagccccgtttgtgaagcggggtttaccctctcagcagagattgtcttggttcactggagaatatttgcattcagccgcaaaagcagcagttggagggggcgtgtgaacgacagaaaacgtgctaacgtagggaacaggggttttgaaagcgaacgcgcgaacagtggcactacagaatccactcgggaaggaacgtgtacgagggcttagagatggagtgagtggttgtgggagattatagatgctgaataccgcccctgttgttgtttgagtgttgtaaaagcaactgcaatcatccgtttccttttccctcccaggcggagctgtgttatcttgggcgacagtggctctgttcatgcatatagctgaggttgtggtcttttggatctttttggtcttggaactttaaaacatcccatattgttgtaattgcctttcgactgtttacgcccctcagcttgttgtcgtcccctcctctttttcgttgttgcaccggcaaggcattgcatgcgtgttttctatcaaatgctcatcgtcagagggcggtgcttttatgtgtcctcctcggtaaaaaagcgagagcagaaacgaataggaaatcgcaaatagcaaaggggaggttagctgggtacttgagcataagcaaagcggtttcttattttaacccatttgattccgagtgtcattctgagggcccctcattaatgtatttatacatactttgttcgaatcttctatagattctccccgcggtccagagtgcctccttcttctcgctggtcaagaaggcttacaacgaccgcactctgagtaagtgacagcagcactggtgatgcaactgctctcgttttgtataacccaacgatcgtcatttagtaacacgccgttgtttgtgtctactttgtcgctatcgccctcaatgaacagtcctcttgtccattgccgcattcgtgtcgctgggcgtgagtatctacgaggactatggcccccaccacaaccctgacgagccccgtgtgggctgggtcgagggtgttgccatccttgctgccgtggccgctgtggtcttcaccaacgccattaatgactaccaaaaggagcgccagttccgcaagttgaacgccaagaaggacgatcgcagcgtcaagctgcttcgtgacggacgagagcaggaggtcaatgtcaaggaggtccaggtcggagacatcatgttgatggagcccggtgatttgctcgctgttgatggtatcgttctcaagagccacaacatcacctgcgacgaatcctcggctactggagagtcggatgcgatgaagaaggacaccgaggagcactgctacgtgatctctggatccaaggttctcgatggctctggctccatgctcgtgaccgccgttggacccaactcgttctttggaaagaccatgatggccatgcgcgaggctactccagaggagaccccgctgcaggtcaagctcgaccttttggccgagtcgattgctaagctcggtatggccgctgctattgctatgctgttcaccctgatcgtcaagtactttgtccaagcgtccatgtccgacgaggaattcccctcgggcgccgacatcttctccgacatggtcaaaattgtcatccaggccatcactatcgtcgtcgttgccgtgcctgagggtctgcccatggctgtcactctcgcccttgcttacgcgaccactcagatgctcaaggataacaacctggttcgcgtcctctctgcttgtgagaccatgggcaacgccaccaccgtctgctctgacaagaccggaacattgacgcagaacaagatgaccgttgtcgagggcacactttcgctcttgcccttctctaacatggatgatgccaagacttggtactcggaggccaaggacgagattgcacagatcatcattgaaggcatcgccttgaactcatcggcctttgaggacactgacgagaagggcaacaaggtctttatcggtatgaagaccgaggctgctctcttgggcttcatcaagtttttgggagcatcgtacagcaacatccgtgccgatatcaaggttgtcaaggtgtatcctttcagctcgttgaagaagaccatgtcctgcgtggctgagacccccaacggtgccgaaaagtaccgtctttatgtcaagggagcttcggagattgttcttggttcctgcacccactatgttgactctgagggacaggtcaagtccttggatgacaatgcgcgcgcccgcttcgatcagatcatcagcaagtatgccgacaaggctctgcgtaccattgctctctcttaccgtgatgtctcttcctccgagttcaagaagttcaacgacgaggatgcgcccaactccaagttgatctgcctcggtgttgtcggtattcaggatccccttcgccccggtgtcgttgagagtgtccgtgactttgccaaggccggtgttactgttcgcatgatcactggagacaacattcagactgcccgtgctattgccaagaatgctggaattttgatcaagggaggattggccatgactggacccgagttcagagctctctccaaggaggagcaaactgaggctgtcaaacgtctccaggttctcgctcgtagcagtcccacggacaagaccattgttgtgcgtcgtcttcaggagctcggagaggttgttgcggtcaccggtgacggaacgaacgacggacctgcgctcaagatggccgatgttggattctcgatgggtattactggaactgaggtcgccaaggaggcctccgccattgtgttgatggacgacaactttagcagcattctcaagtctctgatgtggggccgtgctgttaacgactctgtgcgcaagttcttgcagttccagcttaccgtcaacattactgctgtcattctctcgttcatctctgctgtcgcctcggacgataaccagtcggttctctcggctgttcaattgctctgggtcaacttgatcatggatacccttgctgcccttgccctggccaccgagcccccaagccccgaggtcctgaagcgccttcctacctccaagaccgctcctttgatcaacttcaacatgtggaagatgattctcggccaggctgttttccagatcgtcatcaacctcgcccttctcaagtacggtgcccagctcttccacctgcagaacaagcatggcgaggtttcgccccacaacctgttggtcctccgcaccatgatcttcaacacattcgttttcctccaggtcttcaacgagctcaactgccgccgcatcgacgactctatcaacgttttcaagaacttgcacaacaacaagatctttattcttgtacagttccttgttgtgggattccagttcatcattgttcagtttggtggtcaggccttcaagactacttctttgactggccagcagtggttgatcacggtcttgatcggttccttgtccttgcccgttggtctgtgcctgcgcttgatccccgcccatgtcattcccgagtcggtgatctcgcaccagtctgaggagcgccagcctttggtgtcgtccgccaagttgagatgggagggtgcttcttcgcagatggccagccagggtcacttctttgaggccatccgcaagaacaagcagggcggacacacttcccgccatcagccagagacaggcgacaacaaagcgcaagagtctttgtggcagaagtacggatccaccgtccgtggcgtcggaaactaagtatcatgtttttttttacagccaacacactacaaaacgagaaaaagacaaaaaagatctgtcatcttttatatgatcaatgaaagaaaagcattgaagacctctcctttatcgacggcaacaaagatgaaggaggtagtaaataaaagagaaaaactttacgttgaaatgagacgcgacttgggttgccactggggtattggcggatatgctggcatcatttcaagtgtggctgagtccaactctggtccaactgaagacagagcttcgtgcctttcgaagggtcgtacgtctcaaccgcctaccatccaggaagccagcaacatggaagactttggttcaggagacacggacatggccagtccacccagcacgttcggcgcatcctcgtcatcgtcatcagcgccgcaagcacctaccaaccaggcaccttcccattcacaaccacaatcacaatcacacgcgacggaatctcagttggcagagacgaaatcaactaaaccaaagacaagaaaacatgttcgtgatggatacgtctatcagccgtatgacacctatacccattctagtaaggacactctcgactttgacggcgaattcttgccgtcgtccaagaacaataacagtacgaacaaggacagtcatgatcaccaagcgagtgctacacggatcttggaactgcgaggacttgagagggtaagaactacaaagcacacacactcaagagttccacagctcacaggaccaaaagaaaaaagagtttgcagggggggagctggttcacaaagtagccgtcctccatccccatactcatccaccctctcaactcttgtttcaacctttcaccctctccttcttgacagcgaatcgtccagcttctcgagacggcagggcaagcgatccaaatcctgagcggagatccagaagacgacgagaatgacgaggccggacaacgccttttatccgccacatcactccaaccggctgaacgcaatgcgatggtcaaggcgtacgcggacgaaaaggctcaaaagttcgagacgcttgcagcaggatatgcgacattggtgaatgagatccagtctggactgaggagacagttccattatctgaccaaggcaggtatctcgtcatcgcaggtgccgttcaagaatgtggtctatggagaggagaaggagctcgagacgtggttgaatgctgtggatgtgttgaaggatagcgcagacaggctgatcgggaatgtggagcaggagctgttgaagccccaggagtctgcaggacaatccgagccaggaacaagtcatgaaaagaaatagaagagtgcgccattgtaaagtataaacatatattcaaatgagcggcatcatagttccaaagattttctagatggtgctcttttccagacggcgtgttagctcgtccagttcatcgccaagggcagcctctccggtggcagtggtagtcgttgacttcttgacactggcgactgatacatgcaaaagacacagacaacaaggaaagaaaagaaagatgtgatcaggaacgccttcgccatttttccacaaaatcatgcaaatcatgcaaaccatgcaaaacttgtgcaaaaagaaaaaaaaaaaccttactcttttcgagaggtgcagtcgagtcaaagggatgcaaacgcatgtatgcgctcacgttctgttgataggtcagcttctccagatacgctcgcaccttcagcagctcattgtccgtaccagccctcgccaaatcctcatcgaaatccctcagggccagtccattgtgaggctgcagttgggtcttgtgcgtcgagtcgtcaatcagcactgtgttcgtttgatcaaactgaactgcgtactttgggtgtttctcgccgtcctgtttggcctttttttccttctcgataccctcccagacatattccaaatccttgatcgtcaacacctttcgggcataatccacctccggcaggcggaagtggtctcgcgtccagacacgatccagtcgcgaaacccggtcgccaaatccaaagctgagcatggcctccacgctacggggctgggcactggaccagaccatgacgcggcagtgttcaaacaaaaagtcaaggaacgtgctcaggtgcggtcgcgccgtgacggaccgcctattggacttgttacggtagaacaatgtgccattgaggtccaggatcacaagaagcttgcggggttccttcaacgtcaccggagtctgggctgcgacggtcgtgtaggagggtgtgatggcacggatgggcttggacggataataggttcttgaggcttggtcataaaagacggggtctctgggggctggcgcggacgagggcgtggaccgtcttctgtcggtgaagcgcgttgtggacgacgaagaggaggaggaggggtaggagcgttcttgggacatgctcatggcggtggtgctgaagcggtagtagatggattgcagacggagtgattgaggaatatggagcggagtggaagcaggaatgaggaagaaaggcgaagagcgtgtggatctgtgcaggaaagaaaagcaagacaggcttggccgcgacatgagtgtgtgcggtgtgggatcaggtgcaatgggttgtcgccagcagcaaaagagagtggctcgatgcaaacacaggctacatgtttaaggttggtggcgcacgcgtgaatttggaccggccctcccttttgcccattccaacagccgcacaacacagcacatccacagcacacagaaggacgcgggtggttctcgctttgcaggtgcattcagagtagacacaggcagcaaccagcggtggatcacgtcgtcagccattatggcgtcgtatcttgaccatgtacttgaaaagcgcggactagccctttccaacgctcctatcatctccgcgcccctatgttatttccgtctccgagcccacatgcctcgatgactttaacgctctaatatactgttgatactggtgttcccccccaggagtggtcaggtcaggtcaggtcaggcagacatggtcatcgcactgtgttttcgcaaggcgcgattgtccgcttagtgggtgtgtgacaccagagcagaggcgtgatctgtttttgatcctcgcgcccctttttttgtacctttaggttgttgcatcacccgtcctgaagctgacatcgcgagcaagcaaagactgaggaaacatcctcataaatacgtgaatgagacactgctcgttgcagtcttgctccttacctgccttctttcttctattcctttcagcatcggctctcttttttgccgcgcaaaaaaaaagtatcacgacagcagctctcgtcaaagtcttgcgtttccctcacctcttcactgtttgtacacctccacacgcacgtacacaatcaatcataccatcctcagcaaaaaaaaaaaatgtcagacgtaacagcagccgaactggctctcgaagctctcctcgaatctcgcctcgagatcatcgcagctcgcctacaggcgctcactcccagcacaaagctcctccactcagaagcgcaggcaagcttcaaagagatccaggcgaaatacaggcgcctccaaatcatcgaggactatctcctgcgacttcaaggaaagcccggcctctcacacctctacaccgatgctggagctcaacctagacgatacgtcggcatcggaaacagtgaaatcgaggagatcaagatgggtgtcaagacccttcgacgcaaattccaggctgctggagtcgccgtctcaacggtagggtggtggaggcatttgaaggagaaggacgttgcctcacctgtggctcttgtcgccgtagaagaccaaagcaacaacacccccacacatgacaacacagccaccccattagcagcagcaacagcaccagcggcagcagtcgcggccccggtggcatctgataagagtgctggtggcagtcctgctgcaaagctttctatcgacacctccattgctacacccgccgtcagcaagaaggcagcacctctgctgtcacccaaggctgtcctgtctccgacatcctcctccaacaagaagcgcaacactcttgcgctgcaacagatctttacgcccatgacagctaccaagccgttgcatgagcactttgccacatcacccagcagccaacgcgcgcatccgtccttgggcctcttctcgcccccgatgtcgccttttggtcctggtggagaggcggcaacagctgagaactccctggcgcgaggcctgagcctgcattcgtagtctttgatgtgaaaggcccctgcccaatcaccgtcatgcgatccttaacggccataaataaaagatacacccgctcgttcgtttgcccagagattactgcccatggagggtcatgataggatactggcaacaaattgttgattgatgtcggccattaacaaggtctatttttttgctttgcttccctggacgtgatcgcgccacgcgcgtcctcaactgtgcctctgttgtgaagtttggctcaacacacttttggaagaaggacggatgataacgtgtctttgtagttgggagacatgtatattgtcaaagatgaatttctactgtatgttctcagaacagttggagccgcagtgcaatggatggttactactcaaagccaggagaaaagagaccgaaaccggttctaaacataaacagaacaggacgtcaaaaggcgcactcgcacaattcttccattgtcggcgcattctctcatttctgaagtccgctagtctacagcgatatcagaattatgttacacaactcctggaaaccgcttaaaaataaacttgtagaggtcttcatgagatggctgcatcatcgaatgctttcatgttgactggttatcttttttgtcgtcccatgtgaacctgggatgttacggtgagcaaactaccaggcgtgcggcagttcgcgtgtcctaaccactgcaggcacagagagataaccaagaccctcgcgtagcgaaaatgcgtaactgaaccattgcaacatatgggactgcagcaacctttcgagcgccagattaagacggattctggcggtgaagtgaatggcctgcacgctaccgccttgctccgtcttgcgaccactcatcaccattcatcaagctaataacgtaagccccaccaaaacgcaaagtcctaccggtctttcaacaatttgtgctgtttcaaagcagtgctattcgaaggatataaaacgtcgctcctagccttgctcgccagagctaatagtccgcactcaagtgacccatgacactttatcaagatgaagatcactactctaatttggttgcccaccttcgctatggccttcacgcatgcctctcgcactgcgagaagatcggatactgaggcccggtgcagagtcaagaagccaagcaagaaattccgtgtcccattaaccgcttgcggccaacaaggcaccttttactgtgggaggatctccataggcgaaccaaagcaaaatttcaccatgcttttcgacaccgtaagcatgtggcgcgcttctttccagcttcagcaccaaagcgaccgaaaagcgtcgatccctgactgtatcgatacttttcttcatactcaggggtcttctttcatctggattcccgatgaccattgcacatcccccgcttgcgacggccgtaaaaaatacatgaagtcgatatctcatacttgcaaacacaaaggccttttaggttcttggaggatcagttatcacgatggcgcgaacgccaagggcgaatttgcagcagatcttctaaacgtgggtggcattgagctttaccaaccttttggcttgcgttaaacttgtctgatgattacataaactggcggtacgacggtgtctttggcctaggacccgaggcagagattcctggctccagtgaaaaaacgtttttgaagtccgcggtcaatgggcacatactacctcaacctgtattccctgtgtacctcccctctgggccctctattgaaggcgagcttgtctttggtggtattgatcccgggagatacaaaggcgacctgacctacgttgatatagttaacaaaacgcagcccaaattgtgggcggttacagttgaagacgttggcttcaatcacaaaagcttgggtctgactggccaggcagtgatggacacaggatccaccaccatccgcacatgcagtaaaactgcggaagccatccaccgatacatctttgggtcaagatttgactctcgattggattgggtgattccttgccatcaaacccgaaacactttggacgtcttcttgttcaagataggcggtcgacttccgaattcctgtagcggatcttgtcgctgaacctgtttacaatcaccaaccgtattgtttatccaaagtttcaggaaaccaaggaacgacggacctgtggatacttggcattgcatttatcaagaacaactattgtgtgtttgacatggatccaacaagtggacctcgcattggtatcgcaccagtgtgggatcgagacgggattgaaaaacactgaaagagcaccacgaatctcttcttgctgttgtcttttatatgtgcgtcagtgtttgttcacggcccatttagggccggcgaagaatcaagtgcaatatgttcttgtataatacatcgccgttccgataccatgttttgaagctatgtcgtacgctgtttagacaatttttttttcatcggtgcatctgtcacgtatctcagttgtaaggcaaaggcatgtttgcactcgaccattcactttgttatgttacgcatcgatgttagttatgatttagcaaggacgcactatcgatgtatatcctcttgttagttggcgtaggaaggaccgtctggctcagtcgcattgtggagggggtatgtaccgatcttggtccaacgatgttgatcgtgttgcctagtgccagacgaacctcgcacttgagatgagggctggtcgcgggtgcagcgagcttatctattgcacgctggaaagcgaacaacaatgtaaagcggaagcataggcgggcgtccgggtcttgattggatggggcatgccaagcgcctttcttaaatctctggcgtattcttttctagagagaggtccacgacgtagtcgggacttttttagaagacgacaaattttcgacatgtcaatggacgcgtccactgcaacaagcgacgcgatgtctgggtggcgcacaatacacaactggagcgttaataaacaaaatagttttacatctatcaaaggcaatgttgctcctgcaaagcagctgtaaaacaaatacgcccagcttttaatgtcacagcaaacacagatagacatgcccaatagcagcctgagatttgttctcttaagctctgtgggcagtctgctgtgcttttttctagaaaaagacaaactgtagctgaaagtattgacggggtttaagggacacagagtgggtgcatttctagaaaaaccaccctgatgatcctgatttttatatcggatcttggaggacttgctggatccggacatccgccttgttcaaaacacagatgcatggggcaattagtcagcgtgcacgaaccacatggagcgggggtagagtgccagatatatatagagaaaaatcagagtttccccccgccctccctggtccatgcgcgggtgcaacaagaatggctctgacccggctctcgcatgctcgcaccagtgagcaggcagccaagatggctcgcctgcttgcgagaatagcgaaacacgaagcaatatggatatggtgtacattttaaagatcctctgtatttacacctggaggggggggggggggggtccctgagtcggtgatggaggttgtttgggttgaagaagaaatgtgttttgagtttcgtgctacaagctccttacccagtggccaatggagctgtggaaatccgcagcatggtctttcaactgctatttattactgcgcaagtccattcatacccattcatcctctttctttcttccttcatcccgcttccactgctcaactcaaaggcagactacgctcatgcacttgcacttgtactgcaaattcactagttccactgaaacaacagcatgcatccatacaataaaaccattcagaattagccccgcccaaatccagtgacgtccctgagaatgtgctcgtcaagcagggttctgcatggatctgattacatttgtcgtggtgggactgcaaatccggcaatgatgatggaattgtgccaccagttctcggagctgactttaggttctgatccacctggcgctgatgatgacaatttggcgcgccaagtctctgggctatttgacaaagtcaagccgacgattgaggccgtgctgggcatccagatagagagagactggcaaaatggccccggccccgctttgagctttgacttcgcatctcgctcgattgtggagtgcaaactctgcgacagcgtccatggggccagcaagtacgttgtatttcaaatcgtcgggggttgtttcctcatgcgcaatgactccaaccaatgcagagcaatagccttgaattgggaagaagaacccagtttgaagatgattctggagtaaccgaccactgatgatggaacaagtcaataaacagcgtgcccagttggagaaaggtcgtacacgcatcagacgcagtgccgctcgtagtagtattctcaagagctactctcagcggtacagggatggagctttgaagtccagactgaacacgaatccagacattctggctgttccgcgcacggaccatgggcagggggagagacccaaatatatatagagagaattggcactctgcccccgccaatgtggcccgcgcgtatgattagtaatcacaccatgcatcatgcctcgcagcatatgagcgttacagttggtggtatttgaacaagaagacgcgtgagcagtgtagaataatgtagcaagaatatcaatgcaaaggcgagtgagagcaaggtgagagcaagagaaacagatatagaacgagaatggggcgaggatgatcccggttgcgaagaatggcggaggcgaatgtgagagcgatggcgtgagagaaggagagcagggggaaagagaagtaacgacttttttttgagagagatggaccgagtaagcatgagactcctccctagaagccacggcgcgtccctctccgctcgccccgctcgccagaacggtagcgcagcattatcaccatttaccacgctgcttgtaccgggtcctatggtcaccatctcggagactcttgtagtctatcctgctgagtaatccaacgcattgccagcaagtgtaaatagctctcgctttattacatagaaccccagtctgcaattcaattcattccttgtcctttgtccttaccttccttcctgcttccttatgtccctgccttgccactcgttgcatcgccctggttatttatcttgtcagaagagagcctttaacttgtgacactcagctgacaggtagttgttgtgctgaggatggaaatatattgttgtcatacaacgctttattctcctgattaatccacagttgcactgtacatgctgtacactcgtttcttagttgggctgaatgtcacattattgtcatattttttgaccgctggtggaggcgtcaatgatttcgaggaggcaattgcctgggagaacttcattgtttccaggtcgatctgatgacgctcctttgctctttcaatcttcggtccttggccttcgaggaactcctacagcagtaaaaatatttgtatatatgaataagaactgtagatgtactcaaaaaaggattgtaacaagtttgtactaaccacaaatttccagatcatagcgagcgaggttccctccaaaaaggattccatagcaccagatgtggtgggaagatacaccatggaggcggaagtttttccagctatggagacctcacgcatcggtttgacttggtaaaacagccctacaaatcctacgggatgacaaaggaaaaaaggactgtcatttaaggaattgcattcactgggaggagtccttcatgtacctggttactcaagttcacatacctgctacatcgcccatgatgacagacgcatctttgaacccattggttgcgtgcgcttcttgtagacacctgcctagtcggacattcttgcgacactggagggcgatatccctgctcgagatgtctgtacgcttgaactccacattagagagctctatatccttgtacatgaaaatcaagtcgaccttcctgcccacgtcactaacatcgccgaattcggatggctgtcgctgtcgcaatactttggatgcatccaagattttttcgccactaacaagtcagttgcaatcgcgtgtcaggcaatttcttcgtattattcaatactggacagcatgctgataaaattagttgtctaatttttcactcacgatagacatgcccaacagcagcctgagatttgttctcttaagctctgtgggcagtctgctgtgcttttttctagaaaaagacaaactgtagctgaaagtattgacggggtttaagggacacagagtgggtgcatttctagaaaaaccaccctgatgatcctgatttttatatcggaccttggaggaattgctggatccgaacatccgccatagagtcccaataggtacaaaggtcgtcatacggttcagcaaagaatagtgaagagtcattacacttaccaagaaattgaagatcacataaagagactttccgtcaatgaaatcctctagctccgcggcgtttgttggtgggaaaacagcctcagacgagataaggccgcacacgtaaatgtcgccgaatttctgcgtggtgttaacataaccgagatatcctatggaagcaacgagaggatgagcaagggatgcaaatatcttcatcaagaggaggcaacaatggcggcagccagcacagcaaaaagcgtaccgacaatatctcctcctataacagtggcatcggccctgcctagctcctcgaggacgcgctgaatacatcgacttaagcggactttcttccggttctggcatattggaacttatctggactgggctagcgattagatctccgtgtttgccaactccaatgctcctgctctaaaaagcaggtcgcatcgtcgttcgctctcggccatgtctccaaactcaagctgaagccctttctttacgactttcaaggagttgagtatctgctctttagtatcacgaaggaaagtagggatgtggtgtgtaaatgtcgaaaagctatttgaaaacaaaatgcattgctgataggcacatacgcgcacatacgtgtgaagcgtgatgtttctggacttcaagacactgaaaatggattttcattgatagagacagtcggcctcggatgcctgaaccgttccgtggaatccatgatcaaggtatatagactttccatgacagtaagcacctgttgtcgagatcggtcgccaggctcagccgtccttgcagctgctcgttgtgcaacttcacgtcgcaggaatgatcggtagctattacacgccttgctgtgatatccctcacaacggcgctattatatcaatgatggcttcattctgtgatggttcaggtgtatatacatcgctttaaagaaaatgtgagcgttgagaactttgcacgctgcggtgtctgtaattctctgataagtggaaactctggcgccagtgacatgctgttgcctgcgaaaagaaatcactaaagcatttcgcaaagaaatgagacgaccgatgcacgcccttccaaaaaaatcgaaaaggaaggacaccaaagctggcatccaggcagaccagtcatcagtttgggactttcatgaccgaatattttgtttcccttgtgatcatcacaccttagcatcgcactcgtgtgcgcctacatcgagcacggcataggcagctagcagccatcgaagaaattttccgtcacgctcaaccagggccaaaaaagagggcattcatgggggttcgaaaatacgtttgtgctactggtcagatcgtgtaccctggcgagattgcagtagcttaggcgtgcatcaaacgttttggcactaatcctacaaaatatacagatcatgaccagctccagaatgggatctgttcaagtatgttgcaatacccgagatcttagcctgaggaaacagatctgagtgcccagaggaagcacgatagaatggatccttctcgtggacatccagtcactaatgctacacatactgtttcggccgcatagggagacgtaccgtgagacacactgcgtcgaactacatgtaaaagggatccgctgctcacatcacggtgtttcgatatactgcagacagtcaacgcaagaaaatgtttttcggaataaccggtagagctttcgttactcatcgtatgacagtgcgctcgtggaaaacagttttgtctgaaattttgggcgccaacgcgtggacacgctcgtgaagcaagtttgttataacgttctggaacagcaaagtgttgcgatgaaaatggttttccatgaaccatcgactgttcgcgaccatgacagaaagcgaggaaaagtttgaggagggcaggcgcaaccttcaggacgcggtattagaaggtgattcagtcgaagtacggtgcaatatccttattagatataaagctacagaagctgcttccaatcattattcaccccatctcctcagttcgacaaactcaatgctatcgaagataaagatcgccattttcgtttggtcgttaatcatcatattcatgactttcattggtgctagtccccctaaaagaccggcgactggcaacaccaagtgcgtagtgaaaaagcctcaaagtgaagattctttcatctctgggccactgaccggttctgtggagctgattccatcattgcagctatatggtgaccctggttggcaatatttcgaatacttcgggctcatcaccattggcaggcctcctcagactttcaaggtgatttttcaaaccataagtaagacgaaacaacgttgcccagtaggagcgtcttcgaacatacagaaaaagaatgtgattctcattctaggcacacccacttcatcgctagggaggcaatgtggccccctgggtcgtcgatgtccgctgccaatccccgctttcgccaggaaatttaacggtttgcaatcaattacgtacaacgaacagcttcaaaacacttgggccgtgaatcacggcggaggcagcgatccaaaaatcgtaagcggtgtgtatggatctgattcccttctagtggggaatcttgagctgcaaagcacaatcatcggcttggcttggcatgtttatggtagctttgcataccatggggtcagcggagtgttgcctctgggacctagcttgctggatcgagttacacttatgaaggcagctatcaaccaggaaaaattattcaggccatattttcggtgtacctcccctccagccgccatggaccctatgcgagtggcgagatcgtcttgggggggattgattccaagaaaatccaaggcgacttggcctatgtcgacactatcgaagaagccaactccaccaggtggacgatcaaaattgaggacatctctttgaacgacaagaaattgggcatttccggcattgcagctctcaatactgcaaatccctccatcgacataagagaaagggccgctagagcgcttcacacaggtatccccggtgcacaggcttacggaaaagcgtggatgatcccttgcaatttgagtagtgaaaccagtggccgaatttcgttcaagataggcggacgagacttccatattccttttgcggatctgcctctcaaacctggatcggtaaaggaacagtattgcctatctcatgtaacgggacacaggaaggaggaggaagcatggttactaggaattccgtttttcaggaacaactattgcttttttgatatgggtgaagtgggagtattgaaacctcgtgtcggaatcgcgccgcaaacgttggagtaatgaatgtagatggacacccgtctgatgttaagtagcattcaatacctcacttcgaaccagtcggacttgcatatgcttcactagttcttagcactccagcgtgcgcttgcgcactgttatagtcacacactttcagacctcggtcaatacatacagtaaaggcatttcttttatgtgttattggaaagatttaggcgatggttgacttccagtttttagcacgctcaaatccattctgcgagagttgatagtcgacaaaggtgtcataaatctcctgctgagagttcatcacaaacggtccatgctgcacaatcggctccttcaacggctcgcctgcgattaatacaaagtgcgcatcctctccttgggtcttgatcaggaccttctcggtaccatcctctgagaatgtgagcgtatggtgtgccttgccctggaactccttgtcgccaatgtatgctgtgcccttgagcatgtagatgaatcctgtaaagctcgaagggatcgtctgcacaactgacttgttcttgttcattttgtagtccaggtacatggtcggagtacgcgtaaagaccttactctcgacgccgtgggactcgcccgcgatcaccttgacgacaacgccttcctgaggggtggcccttgggatttggtcatccagcagttcctggtactgaggctcgcacattttgtgttctttgggcaggttgatccagagctgcagtccatgagcgcgggactgtgacttgactggcatctctgaatggacgataccacgtccggccgtcatccactgcacatccccaggcccaatgattcccttgtgtccagcaaagtcttcgtgctgggactgaccctcgatcatgtaggtcaccgtctcaaaaccgcgatgagggtggtccggaaagccgccggttccgtcgccgtcaaactcgtccagcataaggaatggatcgtgattgcggagttcgggtctgccgatagagcggcggacgcgggcaccaacgccctcggactgctccttggagagaacagatttgatgatggatcgtgaggtcttcgccgtatttgaggcggccatgatgactcttgaagactgagttggagtgggtgtggaagggcgacggggcgatgatgaaaagtaagaggcctttaacagcaaaatgttgtgatgtttctgacgctcttgaacaggttgttgaagttgggatgagaaagccagggacgatgcaggcgtcctttttatacaaggatcgtgctgacaagcccagacgcttggccgctcaagggctgacttgcaggagtggcttattaaatggcttagttgtgagagctgatgaagcagacaaatcccacaaagtagacctgctggtgctgacagaggatggagacaaaagaggattaatccattgcgcctggaaagatcgcacaatccccggcgcatatcagaaagggctgcaaaggcacaggaggcttggatcaaaggactgcacgccggccacggaccagtaaactggactttcaaagccgagaagaggttttcgtctagcgaaagccatgttaacagcgaaggacgtcgtcctcctggaaaaacttgatgcttagcttgggtctgtacccctgatgcgtgtcagcccattgccgccgagaatagcataggcaaagtgagatgtgatcaagatatcatctatccttcattttttatcgaaagaattgtcgggagcgagtgcgatattgtctgtgcggcggcaggaatgctgctgcaaggtggccgctgcagacgagtgcctttttattcattgcacaaacgtctttcggcacacggataaccattcttgggagtttcagtgttttgcatttacgccagacgcaggcactccctgcatcccaaaaagggcaggccaaggaaattcccctttgcatgtttaactgcggccctgagctttgctggttacatggcgaagagcggacgaccatgatgatgatacactctactcccctctcaccttctcattactcgctacggttgtgtggaggttccctcacccgggcctctcgcctgtgcatgttggtcaaaggcgtctgtgtgttttgtgcgcccgccaacggttggccagtgtttcgtcaaggtcacattcatgcaaaaaattcagccgttgagaagcacctgaccgctgtttgttgtcgggaatggactggggcagcaggcgcttgggggcagcgcgagtttaaagcccaggggtggtgtgagtgggcgacgggtacgttcgtttcttgatggggatgaaccggttagtgtgtagccgcgcaacacgcactatatataatgagacgatgttcgcctctcgtttttcttcttcatcctccccttcaactctcctttccaccgccatcacgcgattgcttctgtcccttcgcccaaacctttgctcctagcatcacaaccccgactcttcaactctctcaccatggctaagaaagctgccgccgccgacgtttccaagaagagctgcgcttgcggcagacactccatgggcgacaaggagccctgccgcttgtaagtgtgctcctgtcacttgcttgttcaatcctacacgaccacgaattcttctttccgtgttcccgacactgtggtttgggtctttcatagtcactcaagaaggtttctactccacacccctttccctgtgtgtctgcttttcactgactgcttttctgcggtgagagagaatgagcgactttgagaaagagttcagaccacggcgttgtcgtggtgtggtgtgcccgttatgcaatatatttcccacaggccatcgtttctaagtttgttgagagcccttgtgggatgtcacttgacagttacatatacgattcacgtactaggactctcggataggctaaaccatatactaacatcatcctgcctttcatttcacgcccttttttttatatgttagttgccctcgcgtcgtctgtgacagctgcagagaagagtactgctgtggcccgatctgtgaaccttgcaacgcggaccgcgagcatctgatgcagtgtgacaagtgcgaggcccctgtctgtgaaaagtgcattgtcatcaccaagggcgctcgcgagggaaactcgtgcaagagctgcaagaagaacgcccatgctgccgcggccgatgcccagcctgctgccatcagcgtctaaaatagaggacacgaaaggaatgtttatcatgtcaggcaacccgacgatcctgtggagaagtgctgtacatttcccactttctgttgcttggcatactgttccttgtccccatgtatctagtctttacttgaatttgctttgtcttctgccttcgtatgcttacttttttgtaactcttgctcgaccgaccgacaatgatgtatataacaaccactttaaaaaacaatggcagtcgcctacaccgtatcaagcgctgcagataaagaacgaaagtgttacaatatgattgctcaaaactggcgctgcttgggttagtcgctgcgtcgatatggctcgttgctctttcctaaaccagatgcgagccttcatttgcataccgcagccgtgttgattcatatgtaacaaacgtggtcctcggtgctgcttaggagggccaactgacaagtctcgaacgcgaaggctagagacacaaccgacgacatggacaccgtatcacattcttcagtgacattcttcaacgcagtcaagacaaggaatcaattttatagctatgtacaagactcacgaagagtagagcgtccggcagacagcagtttagtagcccccggagtggtcctggcacatactgtcgtggcagttggaacagcacatatcgctgcaccatttttgaccatggctacagttgtggttgttatcactgttatcccagcacttgcccttcttacagtcgtgggagtcgcagcacttgcctccgcaccacacctcaccatggctgcagtcatggtcgttgctgttgttgttatcccagcacttgccgttgtggcagttcttgcagcacttgccaccacaccattcctcgccatggctgcagtcgtgatggtcattatgatcattgtcgtcatccatccagcacttgccgtgcttgcaattctgacagcaacggccgctacaccattcccaaccatggtcgcacttcttcttgctgagagcatcgagcgattcgtctccgctctgggggttcacgggggcatcggtgacatccacgacgggatcggcacggaggtcaagagccgtggtggtggtggccatcatggtcagcacagtcatgatcgccaaggcgatcaaggccacaatggtagcagacttgatatacgagcgcatattaatagctaggtaggagcttgagtttaggaagtttttggttctttcaggatctgttttagaatcaaactgcgagtagagggggccaagaagcaagtcgtatttatagtttcgggcgaagatcgtcggtggctcttttttcatagctcttctccatacaccccaggcctggccccctcccttggtatcccaccgttttgccgcccagcatttttttttttttttttttttttgccgcgaatcaaaagattggcgcgctaccgccaaccaggttccccttcctgcccaatgagaactctagggcaccatttccgtcgcactcttggaaaactgcaagacacgacacgccgagaaggcattgctattctgacctccatcggctcttgtcgattgagaccgtcggttacccatcaacatgctttgcgcctctatacacgactataatagctgagactgaattttttaaagcatgatgctgtatgtaaaagtctgagacttctgactctctaaaaaccattctctaagcctctgggttagggccgaagcacagccactcgcggcaagtcccgcttttgcaatcgaggttctccttgcagcactcgtggtcgagagacagtcccctgcgattgttgtatcttgttgtgtgacacgaggtacccacgtacaacgttgtgttttcgtactgtgctatgccgacacaggcagtgtggctggaggtggcgaagcatgcgacaggtctggtcttgtcccagcaggaggaactttcgccatagttactcaaggtcaagtttgacccgtacggggtggagaatccgcgttgcatatattgggcatgggctgtaagcatgaacagcagggaaacatacatatacttcatggtgtgtatgtgaagcgatcgctgagagaggagcgccagggtacaaggtgagtaaaaaaatccttggtcatttgctaaaaccccaataagagaaataagagaagccttacttcagacccttggttgtgcagatcgtcctgtggatccttgatatgagtattttggggggggggggggggtgatgatcttgtgaggatctgcagggtgcttacagcagttcttgtagtggtttgactgactggcgaatcctgctgataaggtccaatgtatgtgggtgcagcacactttgtgggtatgatgacctctatatattggcgtcttgctccccggaaagtagaaagagatggaccaatgatatcggttcagagacgggggagtgtgctgcatgctgcaagagagcaacctgcccgcgggaaaatacttacgccgtgggaatgggatccgaaggggccagacgacgcagacggagaggtaatcttgacaacaaagatgggcgctgcagcatgggctgagggcgataactgccaagaagagtgaaaattgggctcaggtacgaaatagagtcgggttgttgctgtacattccttttccacctacttcaccttgatcctgctacaggacgagggagcagagggcgtgtaacggtaacacaagtagtataaatagtagactacagtagcacattatctgaaatacattccttttccacctacttcaccttgatcctgctacagggcgagggaacagagggcgagggagcagagggcgagggagcagagggcaggtgtaatagcaataggacaagagggtgtgagcgtgtgaatggacaaggaaagggcaagagagaaagaagaaaggaatacaaggacaccatgggacaagaggaggactctgaaaaagacactgtttattatacatgggcgaggggtttttatactagtgcacaaggaggcgaagtggttacggaaggtggttgcggggtgctgaaggacggcgaagtagaagcgcgtggaggcgaggaagtcgaagtggaagaccgtttttattctactgtgacacgttataaggacttcataggacagttatgagtacccgggtcctgaatcatattacgtggggtggtcttgtggagcggaaaggcttcatgaggctcctgctagtgttaatttcaaatattggaagagataaatccattgcagacgacttccaggtggacgcgcagcaccatagactgttccctcgtggcactcgcgtagcacaacagtgttgacattccttgttctcacttccttgcaaggggttgtgcagttgagtgatgcatctccttaggaagaaggaagaaggaagaaaaaaaaaagatttatgagacatggctgcgatgcgatcggccaatcgcacgcgaccaatgcgcgtgcacggagtggtgtctctcactgtgcgtctcttctttttttcttctgttgcttccattcgagtcccttcgagtccctgggtgttctcgctgtcctcggtgtctttggtcgaggagtcctttcgagtcctcctgtgtcctttcgtgtcctcttgtgtccttctgtctccacccacacaccatcgcactgcctctctctctcacacacaccccacaggctgccttttcaagatgcctcatagcatccgcgactattacctcaacaccaacctcaccagcggcaactactccagctcctcctactccaacaccggcaccagtggtgaccccagcagaggttacacctcgagcttcaacaccacctacagcatcaacccatccaccctgcccagctactcctacaccaaccgctttctgcaacaacaacgagcagccaccgctgccgcacccgcgtcctcaggctctgcgcgcatgtcgcagtacccaccgccacaacaccagtattaccacagcgccccctctggcggacccaacaacagtggcagcagtactggtccagggtacagcagcacctacaccggcggaggcaacagcgatcgatacaactctagctacagcggcggccaccaaatgtcatcgagcggtcctggagcaagcggaggaacgcactccaagacagtgtgccgcatggattgtcggtactgctcggcagtggtctgtctccgaggcatgaaagccatgctgctggcggacaccaccgttgagctctactcaacggatcacccaccaggctcgtaagtcacctccactgcactcttctttttaattctcacgcacgagtcatttttgttttgtcgttgctaacgtgcttgactccaactctctttttctcactctcggactcggactggggaatgtctgttggcgcagggtgcaattgatcgacaaggactataccacctccaactgcaaatgcaaaatccgggacgtggcctgtcgggtctgtggcaatgtgatcggctaccacatcacccaaccctgccagcaatgtcttcgtgcgcccaacaatggtcatttctggatgtttcacaccgagggcgtcgttggacaggagaggctgagcctggatctggccaagcttgtgcaggagctcgtcacctttccacatcaagcacacactgaccgtgagcacccatcatccactcgacccgagcaaggagaacggagagaaggcaccaccgctaaccaaacgacccagacacgagtcgaggcgacccgggcagcagaggctgcaaccagccgtcagacatccgattcggtactacagcgtcagcaacaacagaccctatcacgacagcggcttctgacaacgtcaccaagtccttccactcctacaccctctgcgctccaaccaacacaagctaccgccacaccgaacagtaatgcgatcccgtcctccagtgttccgacgtctacaacaggtcctgtccatagagaagcagcagcaggagcaataggtacctcgtcggctccttcagcctcgacggattcatctcctgagcggcgaccgcctgtcgcaccctcaaccgaaacctcttccccagacctggcatccgaaccgcctctccactcagccgcggcagcgttagcacagctgcacgtcgccttgtttctacagcccatgaaatgggagcagcttccgcacccggacctggacattgatctggatccgggcacgatgggtggcgagcccttgttctcgacccagtgggtcgagttggtcaaacaatcggccgagaccgccgcagccaacatgaccctggcactggatcaagaagaagagacagagcggttcgttcagaggatgcagcttgaggaccacatgttggatcagttggagggttccgaagccagtgatgaccaagcgctagagcaaggcgacgacttgactgaactcgagtcagagactgaggtggaggtcgagactgcggtggaggtcgaaggagaggcggaggagctggcgcggggcatggagattgaggaattgatagaccaagtcgatagctttggactcgccatcccttcgcccactacgaccacggccacgatcacgatgtctcctccagccatagagaggcacacagaggacatcaaggacgaggatccgcatggtgatctagacatggacgtggacgaggagccgacccgtggacgaagacgaggggggctcgagcagcggatgcaatctgccgacgttggagaagccccgccacctggacaggagggtcgtagacgatcgcgcgggccagcctccgacgacggcagaacgacccctcctccggatcagaggagtgcacccgagaaccatcggtctggccgatcgcgttcgagatcatcagagtccgtggagcagctctctccagagtcatgtccgacgatggcgttggcctctgccatgattgccaaggctgcggcctctgcagccgccgcagacgccgcttcagcagccaacaacctcctgtttggacgacggtcccgtcgcgactatgacatgatgtgcagatagcacatctgtataacacatctcccgctcatgaaaatcaaaatagacaagcttttatgtaccaatgttagacgcatatattactttgagcaaaaaaaatattcctttctgtccgcgctggtgggcaatgctactatatgccctattttcttttcttccttctgttccagttttgttcgtttttttttcttaaacggtgccgtcttccagaataccgtagcgggggtatacatccacagggatgcccaagttctccaagttggccaaggcctgcttcacggcgggggaaataatgccatacttgtccgcgaacgccttgaccttctgcttgtcgccatcgccctgcaagaccaagatctcggtcgtcaaggacttgacagcgtcctcgatcctgtccatgaccaccctgaacttgcgggtctcggcatcataggcaaatccaccctgctccatcaggtactcaaactgcatggcctgtcccagaccatgggcttcagtgataccaaagcggatggagcggaacgcagaggcaaggtaggtcatgtagaaggactcggcgtcggggcctcctgccaaagtgccgtccttgagcagcaagccgactgcgtgcagaccagcaatatctgtgttgtagtaaatgtgcagaacaaggaagggggaggaggaggaggttcaaaatgtcagaggcatgtaaagacaaaaaatgtcgacagatatactttttccgttttttttttttttcttttttcgcttttgaccagacaattgatcatgaaccagcattgctgatgatcttaccagctttggcctcttcaaaggcagcgtggtactcctccaacgcggtacggaccttcgtttccttctcacggaccaaaaagtgagggccgagcgaatgggcgacctcgtgcatcaagacgtgctggaagaaggcctcgaaatcgaccttcttgaactggtccttctccagaacctgttccgcaatggggaggagcaccttggcgaatttgctctgttgcacattcttgatgatcaccagcttggagcctgcaatcttgataggagcctcatcgttgggcaagttgtaggccgcggtcatcggcacggccacatcgcctccagagtagagctggttgacggtgatgatggctggcgggtgcagacccttggccttgtagagctcatccacgggcatctgatcctccatgtcctgaaggcggctcgagaactttgccaggatggccgaggactcgaaatcggtggcgtgcaacagaaactcataggcggtacggatcgagagcaacttgtccgtgtagttctaaaaaggtggatccagagcaaatacaggcacgcgttagatccgtcaatcgtgataataaaaaaaaaataaaaaaacgaagcacgatgagacagtacctcataaggtccagcagtgacatccagaggcgagtccttgctgattctcaaccagtccacatcggactcgacatactggttgctgataaaggcttcggccctggacttcaagaacttggccaaggattgatcactgaccaacctagcagcctgcttcatcaactccgaggccgggaccaagaaatccttgtattcctccgagtaaggcaccgtgtacagcgatcctgtggttgcatcccgcttcaccacatggtaatagccctcggcgtcgatcttggcctggccctccagtccagcaacccaggccaggtactcttcctgcttgatatcgtcggggtagaaattgccgtgcactggaggctcatgggggatatggatcgtctcttggccgtcttccttgacggacttgatgaacttttcctcgtccagaccccaggggcccttgaagagctgaagacccagagcgagacgggagtcattttggttcttgacgtgggcgtgcagggcctcgttgccggaccagcgctggcggatatagatctgatcgaacagcttgccgacctggacgaggagcgggatggcttcgcggtcgccggccgagagatggtcgaggtactgggcacccccgacgcggatctcttcgaagcgggccagctgcttggaaagaggggaggttgtggcggctgtggatgtcatggtggagtggcgaatgaggcgggctggaacgacgaagcgagcgtggtgctggatcggcaggcgagcaggaggggcgagtcggggacaaagaagagatctggccagacaggcgagatgctttaaggcaggaatgatgatgagcacaaggcggtgactctttggatggcagctgcgggcgggaactgcgggcacagtcaggcaaggcaagggcgggtgctgtgggtgactgggtgcgctttgtttgctgtacaaacagagttgggtgtgaggtgcggcgtctttgctcacacgcctgttgcttacattgtccacacgtcacagcagcacactccgaagaggttgttcgtgggaacatatgctggccaatcgaaaggaggggcactgcaaaggaagcaagaggtgttcctagtaaggtttctttatggaagaaaaatgcaggctatctatgggcaggaaagtgaatgggcgctctttacttcagcggaatcctcttgaggacaggcaccttcttcagactgtgcatcaggtacagtgcggccgtcaggagcgtcagcgagccagcctggtgggcagtgccgagcgagactgggaccatgtacagcagcgtggcaatgccaagacccacttgacagcacgcaacacccatcagcgcattgacacccaagcggacatgaggaggcagcggcaggcgacgcgagtacaagaacagggcagagacagcagtgaaggtcgtggtggcctatgaaataatttcccgagcgagagagaaatattagggttgcgtacgaccatgtcgagatagacactcattcacacatacaactttcgagtagcgacaaatcgatcgagcgcagtaggcaacagaacacttacaaggacacggtggttgaactggacagtgacctggttgtcaaacatgtttctccagagtccgaccttggggtggtcgttctcgtgcacgaatcggctatcaaagagctcgttgacaggaggcatcaaacggccacccatcaacgggaactcgttgtagataagaccggcatcgagaccagcaacaaaagcgcccgagatggcagtgaaaaagaccagagcaacaattccatgagcatggcccttgaaccgcttgagaacaggattgttgatcgcagcagcaagggactatcgtggaagaaggcgataacactgcaatgagtaccttcacactgcctgtgcaaggaaaaagttgaacacctgacaaatgtgcagtggcaatgcttacctcgtaagctcccttggaaatgctatagtcagtcagcaccttcattccagtcatcagggcaccagcgtaaatcaagaaggcacttcccaaatgagcagccagtctgtactgagagactcgaggcgtggcaccgggtgtgttcatcaattgctcatcaagtccagacttgaccatataccatccaagtgcaccttggaaaccaatcagaccaccaataatcaaggaacgacgggcaatgttcttggatagcatgccacgggcagcaaagtaaagaccaggtaaaatgaaggcggcaccaatggcacggccgagcatacgatgggaccattcgtagtaaaagatgcgcttgaattcttcgagtgtcataccatggttcaaactaggaggagcgtccatcaaccgtaaaaggtaggaagagtcgttttgttgctgcgctgttagtcaagagcagtgcaaaaaaaacagtcgatctaaaaacgcgagttgtgctttgcgtgatggctagatacccagacctacatcttgtattccgggaactgcttgtactttgcaaactcctcctcccattcttcctgcgatctaggaggcttcatgcccttgatcaagttccattcgacaatcgacagcccactctcggtcaagcgggtcatgccgcccaccacgacaatgccaaaggtcatggcactgatcgtcaacatccagtagccgacaatgggcttcaccaccacctcgggaacagcagccgcagggctcttggccgcaactctggcagccgaggccgaagctgtgctcgaagctgtcgtcgaggcagaggcagaggcagaggcggctgtggtggtggtggactggaagcgggctttgaccatgagagccgttgagcgggccgacaaggtcatgcgctgtgttgccgctgctgcgttgatggacagggtggatcggaggactgatcgcttgagtgcatagttgttggctctggaggagagcgagcgggtggcgaggccatgcgctgacagcggagagggtgtgtgcgcagtggcccgaacgagcgtcctagtcagcagggacgagaacgcgttggtgcagaccatggtgacgcttcctttgtgttgcttgcagtgggtctgttgcaaaagagtcaaagggaaggaacggtcaaggaaggaaggaaggaaggacggtaggacggaagaagagtgagcgtggaacgagcagaagagagatcggagcaaagtgatcaggctgactagagggcgcccttgagcaaacaggatccaatggcggtaccgctttcggaatcccgaggcgcccactgtctcgcaagcgccagtgcgcttgtttgtgtgtgcggggctgctgcactcgcaagacagtcacaaacatggcttaatccgctggatcgctacacgagaaatcgcaacctcaagacccttccgaggtcctgtgctcgtgaatagacgtggtcaagagcgaggaggcaccagcgtggatgcagccctttcgtaagcgctgtttttgagatttgttcgttgcgctttacaatatgggatgccatctcacttttccagcaactgagttgaaagttcactcgctgactatcactccggttccgacgatcccccctgtttcatctacgtatggttaaaattaggaccaagtccacaaacaggtgccagaggggaacaaggaaggctatttgaatgtgagccatgtagcaatcgacgtacatttggacgctagacgtctatcgggacgcagatttaaatacctcaatgtaaacatgggttcgtagcaaagctacattcactgaaaagtccgagaaggaagcaggtttggcaagccaaggagtgcaccactttggcaaggagtgcaccgcgaaggcacaaagggaggggcctcacttttcaacagaaggctgaactcaactttaagaacaatctggacaggacacagcccgacttgatcgtcaagcaaaattttctgcgcctcgagacagaaaaagaacagggcgaacatgcagcaacgagactacggctgcaagggcagatccaattgcccccaccagcatgcacatacaggtttgcgacggctaaactcaaggtttggttgtttacaagctgttctcaccacgctttggagggttgcacagtgttctgttgcaagtgtgctgtttacaacaaaaaagaggaatggtattctcacgcattttgcagtgcctcaccttgccgcaccttatcgcctcagtccgtatctgctggtgctggtggatggcgagggcgtgcgaagggctccaatagaggagccatggggcttcgaacaccgtcgggtgcacctcccatgcaaccgttgcactctgcccaagacgaggtgagctggcaagctggcaatgaactatgggatgcagtgcaatagtacaccactgaagtgaatctgtccctgtcgcagacacttgtcctcttgcaccgtgccataattatcatatcatgcacactttgttttctcgccttgactctcgtttatctctcactctttctctcgctctttctcgctctcgccctcattctattgacgtctgcacctctgtttccaatcttccacctgttcctcctcgtcgcttgcatcctccaaaggccccttgtccctgttcatgcactgcccgccatccacccacccctgacagctggcgagtgcagcaagacaacgacaaacacaatcatcaaacacttttgcccattcaccccctttgctcgctagtcattcagcatcatggcaaccgcactcccgccatctcgagcaccccccatatccaccgcggctcctctccccatcgccacttcagcactgccaccaccaccaccgccccgagtgaccaccccgcgaccctcaacagcacgcgcagcgagaccgaccaataatgtcccaacgcccgtcgccgctgccactgtcactgccacagcgcaatccgacggaatgagcgggggtgccgttgcagggctggtcgtcggtgcactcgttgtccttatctgctcagtcatcggtgggttcctgctcctcaagaagcgacggaggcgattgatggccgcaggaaagcgctcgcagtactatgacgactacacagcagcctcagccaggacactgaaccacaaacaggatcatgatgactacggccgaggtgaggcgaaggaccgagccggcggtctatccgacatgtggactggactccgcaccaaggcgcaaaaggttgccgagagcatcaagaagccatccacaggagcagcagcagccccgccagcaacagcgccaggaggagccatcgccttgcaaccactaccgcctccaccgttgcagcaaccgtatcagcatgcaagagccataagtcctgcgttcgtttctggatccgagagagctgcatcgcccgccccgacgcatatgaacggcgtccttccacccaccgggccactgcacttgccccaggagtcgtacatgacaccacagcagcaacccgctctccaggttggatatacacactcggtctattcacagggcagtgccgccactgggccttatcctgttgggcacccagcgccacagcagcagtatcatcagccatatgcgaacttccagcagtcaaatgcattggtgccagcaccggcgccaacgattacaactccggccagtcagccctattattaccagcccgggacaggattggtgtctgtgcccctcagtcttcctcaccaacagcaaccgtttatgcaacagcaacagctacagcaacagcagcaacaacaacagcagcaacaacaacagcagcaacagcaacagcagcaacagcaacagcaacagcagcaacagcaacagcaacagcagcaacagcaacagcagcaacagcaacagcattaccaaaatcaacagcagctgtaccaccagaaccctgcaccacctgggcctatgccattcaatgctcaaccataccagcccatgcccccgcccgcccaggcagtccacaacattgtctatcccgcacccgcacccgtaccgcttgctcctccctcccaactgcaccaccaggcaccgccctcgctccaacaggcgcccgttgtttctttcccacaaccaccatccgctcccgatacctcagccccaatatctgtcgccagccctactctagcgacgcccgatccaggatccatctttttaccaggagatgccacacgaccattgctcggccagggacttttcaagatcgttccagacgcagaggacgaggaagaggccaagcgcgtgatgaaagcgtcaggttcaggaaccgtcaatgactcgagtgtcgtaccgccactggacctgtacctcggaggcgactttctgagctccgtgatccagtaccagaaccagaaccaacggttccaagcattggaggcgggcactggagccagcacggtccatgtaccctcgagcgagagtctggcagagggtagcaccgtccctccacctgttccttcgaaaccagagacagctgccgatgttgttgctgcgagattggccggcaacagccaggcccccacagccgagcccgaggcccttgccagtggagagtttcaggaatacagacgtgagggtgggtatcacgatcgactggcgggacagaaggatcgacccaaaaaccaacctcggtatttgctggacaaggaagaggtgatggatgagaagcaggaggtaggagagctggagttatctcagcatggtcagcaaccgtccgacgttgtgattgtggggagcgatattgtgtttgaacctttaccgagtgccaaggcagcggccaaggctgcacagagagcctccatggcagtcgctgacacggaggcgagcggagagaactcagcgaacgaaccgtcatcgtcagagtccatcgtgtcagcgacacctgccacgtcctttgtgggtcttgcggagagttcaggacagtcgatagcaggtgagccattgagtccaagaacgcttcagcgtgggacgaccattggaatggctttacctacaatcggcacagaggagtatctggaaaggaccgatgacaaggaggagtacagttttggggctcatggagataggcgggcgctggcagggtcttcggatgatacagcggtcgtgatgcatccgccgacggtcacggctcttgcgagtgaggcacagggtgacattgtatatagtgaggcacaggaggatccatcaacgctgtcgacttctgcggcgtcgtcatcgtcgtcatcatcatcattagtaccgcctccgctagctcgctccacaaaaccaaagatgataaaatgatctcgtgttggaaaacagtactcaaaagttttttttcctcggatgcagagcagcggaaatagacgttggagtcgaagaatgattctatcccaaagcgagcttgatgcgatggagaaaaacattaactgtctgttcctccaaagcatgccgccaagtaggataaaacagcgtcagcgcaagcgattgggcatttcacgcttccttgatttgttacgggatgaacacttgtcctttgtgttgcgctgccgaccaaacaatgagtacaaacaatagtttatttctgatcaccacctcgaagctgagcataatctaacagtcctcggcatcatcatcacagggctcaactggatcgcccagagagcctccctgttgcaacaatttgatgtttgctctgctcagtccacgcgtgttctggagatttgtatctgaggcagagagttggctacgtccagagctccactgtaagcaaacacgatggtgattttctgtgattttccataagcgcacagaattgtcgtagcagccggttactaggtaattgtcgcctctattggtgatccaggcaacagctgcaactcctccaagaaaccctttgaccacagtcaaacactgacctgtttccatatcccaaagccggaccgtcgtgtctctactacccgaggcaagctgctggccgtttagcgagaacgacacgctcagtacctcgccggaatggccgctgaaaatggcaccaggttccccggtttgaacgtcccaaagacgcactgtcttatcatcactggccgaggcaatctgctggccgtttggcgaaaacaccacactatttacccagtcggtatggccgctaaggatggcaccaggttctccggtttggacgtcccagagtcgcaccgtcttgtcgccactgcacgaggctatctgctgtccgcttggtgaaaacgccacgcttctcacaccttgggcatggtcagttaagatggcacctggtgcaccagtttggatgtcccagagtcgcaccgtcccgtcagagctgcttgaggccatctgctggccgtttggcgaaaacatcacgctcgtgacaacatcggtatggccactagaaatggcaacagaggcaccagtttcagcatcccagagtcgcaccatcatgtcctgacttcccgaggcaatctgctggccgcttggtgagaatgccacggtcatgacccatttggtatgtccggtacagatgcctctaggtgcaccagttcgaaagtcccagatccggattgtgttgtcatcgctgcttgaggcaatctgcaggccgttcatagaaaccgctacactcctaacatagtcagtgtggccgctgaaactggcctccgatgtgttggtttgtgcgtcccagagtcgcaccgttttgtcgccactgccggatgccatctgctggccgcttggtgaaaatgccaggctcgtgacagatctggtgtgaccgctgataatggcaccaggtgcgccggtttggacgtcccagagtcgcacggttgtgtcagcactgcctgaggctatctgctgtccgttcgacgaaaataccacgctatttacgccttgggtatggccgctgagggtggcaccaggtgtaccggtttggacatcccacaatcgcaccgtcttgtcgtcagcgcccgaggctatctgctgtccgcttggtgaaaacgccgcgctcttgacagttgagctatggccgttcataatggcaccaggtacaccggtctgtgcgtcccagagtcgttctgtcttgtccatactacccgaagcaatctgccgtccgtctggcgaaaacgcaacgctcacaacctcgctggaatgaccgctgagaatagcactaggtgcgccggtttgggcaaaccagagtcgcaccgtcgtgtcatcactgcccgaggcaatcagttctccgcttggcgaaaccgccacgctcctaacccaatcggtgtgaccactgaagatggtatcagatgtaccggtttgtgcgtcccaaagtcgcaccgtcgtgtcatcactacccgaagcaatctgctggccactcggtgaaaacaccacgctatttaccgtgccggtgtgaccgctcagcgtgtgcacccttctccaagttgaggtttgatatacgctgattgtaccatcctcgaggccaacggcaagtgtctttccatccggcgagtacgcgcagctattcacctcgctctcctcctgcaggaacggccattcaccaaactgtgcgcctgccatgtgtgcctcgcttaaatctgcctgacgcaaccagacactgcgaaggttcgtgccgctcaaatccgctccttgcagtcgtgctgaatcaaactgtccgccgctcaaatcggcccctggaatctggatgcctcggagatcggcctcgttgaatgttacaccagcccgaaccaacgtagtgatggcgttcgctgctgcccgactcgccgtgccatcggttttggatagctcgataatctgatggagacgctgcttgaaatcggcgtctctcttgacatgctcggccagaaagtcgatgatcgatggttccttcacgaggttcgtctggctcatagggtgttcagcgacgcactgtgagccttcaatcgacgagcctccagccgcatgtgtctcgtgtatgtgtcgagagtaaaagtattctagaagcgagcgatggatgaattgatgctggacacctgcacgcgacagagggctggactctcggaggatggtgatatcggcctgagaacaaaagaacttgcccttccacctcgctcgatcgcttctggccgtgtactgaacaaccgggttaccgtcctgctcccgaaatatggccgccgccaggtcctttgagaagtcaatggcgctctgtacaaagccatcctcaagcagatctctccttgcagcgtctgcctctcctgagagcgtcatggtctccagccgaagtttgttggtatcgagccattgactgatgaaggagtcgtacagcgtcagacgcgtcactttgacattggcgagatccactgcatccttgaccacttttggcagggccttgagcgccagcttgagaagaaacgggtttttgaccaactccatcatattgggaatcgactgtagcttggtcatgtattcctcggtcgaccaaatgggaccatcgcccgtcagtttgtgtacctccgagtctcgtacaaactgacagacatagtcctcaacttgggcactcgagaagggtacaatgacagcttccgtgaacagactggtggtgacgccgttatatcgatcgttctgctgaggctggaagaggttgcggtagtcgcttccgagatggctgcttctgcagctgatgatcatcttggtgtccggctgtcctttctggttgagcagattggcggtgtggaggttgaccttcacctgcgtctcgtcgtagccatcgcagatcaagattatccggcggtgctgcttcaactcttgaatctgagaatcagaaaacttgtggatgcggagctgcttgtcaatcaaatcctggtcgggctgcttgatcgctggtaggttgatgaacaaggggatgttatctccgtgcttgtatgcctcccacagctcgtgctcaacgtgtcggttaaatgtcgattttcctgctcctgaatcacccaacaccagaaacacatgctgatcgctgcgcaagaacccgttgaccttgtccatgagcggcaaggcgtccttgtcggatgcttggaggctgggtttagccagaggagggatgtatacattctggttgtagtcctcgagtcgctcctttcgaagacggtgaatgtcgcgttcgacattggttattccctgcactcgcgagagaagggaccaggtgtctggaagtggcaagtgagatatcaaaggataagacgcattcaacttgacaggctcagcgctgttgggattctgcttgttccatcctgcagggacctcgatcttggggtccacatcgtcagagatcatgttcaggatggtcatcatgaggcctctcacactggtatcttgaccccacgttgcatcgttggtgtagagctcgatcaggaaatcaacggcctgttggcggacggcactctcccatacatagtccaaggcgatctgtcccagtaactggctgattccccactgaaactcatggctcgatcgacaagtcgccttcagcacaacgaccttaaagtcagcaagccgtccttcccgaaccaaagcctcggctccaacgatggcagggtaccatgcgcgtttgtttccagaactgatcccattcttgactgcactgaatacatcttgtccgctctcgatcagcgaccgtgcaccctcgtaggctgctttggcaatcccaatggtgtcgacaatcgtcttttggacttgcgttatgccttcaaggaacccgccgagatcgagattgacgatgcctgagatgctgatgagaccctcagccacggcccctgagcgcctcatcactgcctggagcgctgtctcgttatcggggatgcattgcaaggcctggaatgcgtacgctgcctgatacatcagaaatggatccgagctatctcgcaggctactcaagatggcagccagcggttcgtgctgctccactcggtccacatccttgacctcgtgcttggccatgacatcgagggttcgcgacagtgccagggtaaggtggtaagggtgcacggacgactgctggtgggtgttctgcaagcgtgctcggagaaggcccatgatcttgacaagatcgtcttcaacaagatatcctgcagaggcacattgcatgagctggacaaggccgtgaagcagatcgacatccaggatcatggactggtcaaacttggtgatgaaacaagagagcaggctgcggtagtgctcacgaccaaggacagggccgaggaggacgacctctttgatgacagacgagcccttgacagcgtctttggcaaactcctcgaccatgcgcgtcagtagccagcggatgtggtcctgctcgaccttgttttgactaatctcctgaatccaatctcgatatgctctgttcgccagtgtgtccgcggagactttctgcagcaaaagactgttacacaaaacaagttggggcgtggtgtcgatacgctcgcctggcttttgcagcgtgatggtggtggatggtcggcccaagttctcgctgaaagcggtgcagctggctatggtcgtggtgctcgtggacaggatcgtcgtttctgaactgctggcttggacagtgcaactggcgttattgttgatgctgttttcagcctcagtgctggaatcttgggtgtgaagggcctttttctcggggggaggcgtccgagtcccacggtgagaatccgacttggaacgatgccacaagttgcggattttgtcgcgggtcctcatggtttgaggtggagttgattttggatcagctttttcagcagatgcggctgattgactgtttgatgagccaagcatggcaactatcttaacgtcggatcaatgacatggaagcggttggtgaatatccacgttgattgatgatattgggttgcgaggccgttgaatgttctcacctttcctcgtgtccagacgataccctcacactcgagagaggtcaaaagtgttgggacgaaagaatcgcgaggtgagatggcgatgggagtattgaagcacctttacatatggggatgtgcgaaaggagacgctatcaggttagttactgcagaccctgaggtttcatcaacacttgtcaagctgcagtggcatacctgaaggcagcttttggtatcctggatattgggttacagaaagtgaacttggtgagggaaagacgaaaagatgtgtcaatagatatgtagctcagagaggagatgctcgactcgagacggtcaatggaaagacgggatgctctgggaaaatgggagaaatcctgcgtgtatcttttttttagttcagtcttcgccctcagtctttgcacgcaatctttctttgtgtgacccgagcagtgcctgcgaagaaattctctgaggcaccgccacagcttattggacatcttcaagtatcgctgacgggcctcactctcaacaggctgacatccctagagaagaacgctctggctacgagcaaagatttggaatacgttgtatttcctgtgcttctacccgcgtgcgatacgcgctgtcatatctttcgcggggctgtattcaagtcagagggcgatgatcagcttcatgttcatcatggtgagcgcgcttttcatcgtgaacggagggtcatacatgcccttgaaccctcaatcaagccacgaacacccctggaaacataaccaggttgtgttgctgaccattgtcctccatgaaccatcgcggtagcagtggaaaggcagtttcccagcggtttcgaagttggcacacttcaacgtaccaacgcaaaaaggaaaaacaaaaatcgattctcgctgttgttgcgcatcatgctctccaccgtagagctcccatcttccccttcttacataacttgtatacgcgtccaatgcctcagagacctatggtctcgaattttgggcggaagggcatgccgcttgatctgttggaaaacttaataatcttagcgcactgcgtgaccgctcacacaatgtttggtgtgttcgttccactctactcagctcaatgcgcgttgcccttgacattcccagcaagcccaccgaccctaatacaatcaaggacaacaatcaacatccagaaaggacatgtcaatacggagcctgcagatccccaacaatgatgcaactcagagactagagcaggctttccaactcatctaccacagcccgcaagcaaagtactgccagctctgcaagacgttccagcctctcgggggtctgccgcgtgcatggctgatcaagggcgagtcaggatcaggtatcacccatgctctaaccctctagtccacgcctttctagccggagcctgtcgtgccctctgctgcctctgttgcatggatgctgatctcaaaattcttccatggatcacaggaaaatcatatcttgccaaggcccttgccaaaaaatatgacgttcagtataccgcagcagtgacgatcggagaactggccattatgtaccctggggatatgctgaagggactaaggacatacctcggatccatcaagggacactctagagcactcggtaattttcaggcgcttgcgatgcgaatgacatgtatgctgggcgctgtttctcacactgccctccacctgtctagtgattctggacaacatcgaattgctgttcccccgcgaggaggtcgattttgcattagtctatgcattccagtcatggatgcaggaactcatggaccaggagaatcaagcgattgaggcctcgggaacgacagacactgcaatacaaagtccacgcgtcttggtgctggggatcacacaggatgttcgcagtctagacgaccaggttctgtcactgttcgatgattctatcgagctggatattcccaccccagaggagcgacaggtgatacttcaaacatgtgtggtaaaccacggcatcacggtgcagaactcggatcaaggcgaccaaaactccacggaagcagcaatcataccagaatcggcagtatctccagagttaagggggtccggttcaaaacatgcaatagagagcatttccataaagtgccatggctacctagcagctgatctggacgcactctgctcacaagcagccgtgattgcgagccagcaaggtcgcgcgatggacacgctgacggtgcaggattttgcagaagctatgaaattaattcgagtatcggccttgagacagagcacaagtgtacaaaaagtcgatccggtccactggtctgacattggaggactggaaggagtcaaggtaaaaatgcataaaacaacatacatttttctatgaggaaccgcataaggggaaaaaaggttcgccgctgttgatgtcgctaaaactaacacttgtcacacccgagtagaaagtcctggaggaatcagtgatctggctgtacaagcatgcagaggcctatgcacggatgggcatcactccctccaaaggagttctcctgtacgccatgctttcgttttttactggagggtaccactcatctctcaaccttcagcgatggcagttactcacccacatttcttgacacactattctacaatctagatacggacctccaggaacgggaaagacgttacttgcaaaggctgtggccacagaatccgaggccaatttcatggcagtctcgatccctgatctgatcaagggcgaagtgggagaatccgaaaaggccattgccaaggtcttcaacacagcaacgaggtgtagtccctgcatagtctttcttgacgagctcgaggccatctttggcacgcgagattcgagcggtgggctagggaagcaggtatgatgccaatgcctttaaggccaaatttcaagagagtggaggggttgtttttactgttttgctttttctagagtaccagagacgagccatggctaaagacagtgtccttcttgtctctgcattctcaatagctcatctcgcaactgctactggaaatggacaactgcggaaagggcgtggtgatcttggcggccaccaatcatcccgaggccatcgatgcctccattttacgaccaggtaagtaaaatcaaagactgcagaatgaaccgaaaaacgaaaacgcgttcaaagttggctgggggaagctttcttttactgcttcgcaggctaatttcgtcctctcatgctcatgaacgcaattttggacaattttcatcgattttaggacgcttggatagacttgtttatgtccctccacccaactttgaagagcgagtggcgattcttgagatcctcaagcacacaacccggttctcggacacggttgacctgcggacagtgagcaacctgaccaataactttacaggtgctgacatgaaggctatagtgcgcaaggcaggactgtatgctttgaaagccaatagggtaaggtgctggcgcctgaaatttgggcatcggcccattgctgcccgtctttgatgttttgtatcagttcattcggcagaggtgacatgcaaactgacatatcacgacgcgttgatgcatccattcttttatagacaagtatagacgcacaagacttcttcgctgccacgtcggacgtgcaaccttcggtgaatcaaataggtttactacgctacgaacaattctgtcggtaaccgtcctccgacattagggagaataaaaaaaaaattactgtccagttcacatttttgaacaaatggaaattaaatccgcgagttattaaatcgcggcatacactttgccatcaccattgatcatcatggttgaagccgaggccatgctcctatcaatgctacgtacgcatgatgtagcgatgacaactggcagtggtataaaggtcacctcactctgggatacgattcctcattgcctttgcactctcctccaccgcgacacccagaggtaagtgttctttcccaccagcaggaactcctcgcctcttcccctttcggctccagtctgtctgatcaccctcttttcctacttagtccttgccgacctcgccaccacgtcctaaaggacagatctcgccacagggtatggatagtgttatgatctagtctgtatgcgaagacgtaatagtaacggtacaccgtgtctgatcgcctcttcatgattgtgatagttgggactgcaaggcctggagttttgtcgttctccatgatcaaaaacgactacccaccaaaaaaactcaggaatcctgagaagctcccacctgccacccacatccatgcgcgatgcaagggtggctcctccagcaggaggtttatggtaggtagtctgaagtagtcgtgtcgaagtaaaagcttcgaacccaaactaatatcttttctcacgttcatttttaaatgaaaagcacaataaggcgatgcgaatgtggatgtattttttctacaatgattgatatggtacaaagtggactggcttgaggtgctgcggacataaatcaaaaggcgctttggccagtgctgctgtattccagaagcatggccgcagtcaaagtcggcttgacagacgcaagggccagtcgaaagtcctccgcgttctaatagtagtcgcagccacgttgagcgagttacaaaaaatatcagatgctgccttagatgacaatgctcccacatgagatcaatcctatgcaaaaagaaacaaaaaaaaaaaaaaaaaagacacgtaccacaggttcagtcgacgccatgttttcgtccgcaccctcgactttgatttgcatcttggccattgggcccagaactcgcgatctcagagcgattagcgccgcctctctgcacaaattctgcagatctgctcctgtaaacatctccgtctaaataaacgtgaaaaaaaaaagatttgaatatcgagaacgctgcgcctttgcaatgatctctaaggtcgctttgggccgcaacaaaaacctttcctaccgtttgagcaagcgcgtcaagatcaacctcctcggctaagggaatgtccctggtatatatgctcaagatttgcctccttgcttcaagatcagggggaggtacctatccatataaagaggtcagtcagaccacacacgtctagtgggtgacagcttctcatgagaaagagtgagcgacggaacgaaacttacatagacaacgcggtcaaatctccctggacgcaacaatgccttatcaatcaagtccacgcgatttgtggcggcaacgatgaggactcctgatgcattctccactccgtccatctcattcagcatggtggacaagacccgctcctgtacactgtccccaccgccatctccgccgcctcctgcagaaaagttcctcttcccgacaatcgtatcaatctcgtcgaaaaagatgatggagggagccgacaatctggcttggtgaaaggtctcccggatcgtcttctctgaatcgccgacaaacgaagaataaagggcggcaccgttgaccgagagaaaggacgcgcccgagttggtcgcaatcgccttcacgagtgtggtcttactacacccgggaggtccgtagagaaggatgcctcgaggcgctttcagtccgagtcgcaagaacgtgtccttgtacagaacaggccactctactgcctgacgaagttgcctcttgacaggctccaggccgccaatatcggtccacttgaccggttccaccacaactccatagcctcgctggagtgaaggcgcattcttgccaaatgcgtttttgaaatccgccatggtcacgctgacagaagttgctcccagttcgttcgtgcccgatcctgatcctgcaatgctcctatggacagcactgagggcactttcccgacagagcgcctcaaggtctgcacctacaaaaccattcgtcatcctggccagacttccaagttcgctctcagtcagcaagtgcggcatatccttgatcaggctgctgatgattttcaatcgacttgtctcattgggcacctccatcctgatctcgcgatcgaaacgtccgggccgccgcagtgcgggatcgatcgagtttggccgatttgtggctgcaatgaccacgaccctgcctctcgacgccacgccgtccatgagagtcagcaactgcgccacaaccctcgactcatgcgcctgtgcatccgttcgatgtggtgtaagcgcatccagctcatcaataaaaatcatcacaggccgcttggggtccgccaatgcaatcctgctagcctgatcaaacttctgccgcaacttttcctcgctttcaccgacatagggtccaaagatctcgggtccgtaaattgttatcatctgtgcgcggcaaatgtgggcgactgttgaaaccagcaaagtcttgccgacaccaggcggtccgtgtaaaagaattcctttgggacactcgatgttgagtcgtgaaatgagctctggatagagaagtgggtaggacactacctccaaaagagctttgatgggtccttcaaggcctgggaggactttgagattgcgtgcaaaatccatgccgttctgtgtgtctgaggaatctgcgactccagtgctgacgccgccgcctctgcttggcttctcctccttgacaatagtgacttgagttcccttcgtgactaacagaggtccagttgcgggtaccgatgagagcaccttttggaattgcacgtttgactgttagtatataccgatcgtgtcgattaccgcgtgtggcattgtaatcaagtgcgaaatgcgtctcaccttgatcaagaggccgttgtgctcattggtgattgaaaatccttctcctagaaccaacgtctccagcacagtgtgaaccatctaccgacatatcaaacaatttccatgttcctgtcagtgcatagctcttagaattgtcgataacggcgctcataaacgagaacgctcagcaaaggtcttacgtttcgctgcatcaactctgtggcactgtcgtaacctgatcctgcgacacttttctccagattcgaatcgatccgcgtaaccgtgacttccagccgctgtgctttcaatatcggggatccgagagccctcaagcctacaaaatgtagataaaagtcgtcgctgccttgttaaacactatgcagcagttgtttttcaccagcaacgccaactggacttgattttcccctgtccattttcgacgtactgtacaaggtctgctcccgtatccgagggtcctgggcttcctgtcctcgtgtgatgtaacgatccaccagaacagcgtcatgacaattatgccgcgcgggccaaactctgacatgggtctgatcctctgcattcgtgtccgcttgcaggacagcccattgacccacagcgagtcccagctcctgaaatcttgcgggcgaaatgcggcatcgagccgtctgccgatcgcagtagtcagctggaaggtatctgtacattccaggatcgaatggtcgccgcagaatgcaagaagagtatggaagtgaatcctcttcaggaagccgcccgcatgtcctaaaactagccatttaaggggtctttattggcgcgtctaaagttcaaaggtagtcagcactgagctaaagtaagtcaaggctacataatccggcttcgccttgatgagccgccgcatcaccccaatctcgccactcccgcgcagctcccgctccacgtcccttccaaacccctctgtctccatagcagtcagctcgatccggagtcggtcctcaggtcccgaggccctataagccagctctagcttccagccatccgtcctgaacccgcccgcatgccgaatcacataatgaaacctttctcttgacggtatatccagtttcattgaccactccaagacctctgcgtcaaaacttgtcacggtccagatgtagttggggtgcgtgcacaggatcgttagcctccggatttgctggacagggtcgtaagatatgttctcggccacgagtcggggagcatcttcaatcagcattgtcagcggcatgtccgactctgagagggtcctgttggtggtgtgcttgcggatgtaaggtgtggtatcgatgacaaacgactccaggaactgactgaacggatagactgacttccagtcgcttggactatggctgatatcccgaaagtcggccttagtcccgaacaactcttcgacctcgatgatatagtccctgaacggtccaggatcacaatgtgcaaggaacagcaaggactcgcctgaagtcatgtttcgctgatgttgcacgaacactcgtttgggatggagttcatcgtaaggataaaagacccacgatgatatgagcaacagcaagagatgcaaggctaccaacccgatgactacccgcttcaagagtgctcgaccaaaccgatgagaaaacgccagcagaggtggcgcaaacatgaacatcccgaatcccgttacgccagctacgattaaatccaccggcgcagtaactccaatacgacctgtcaacggcactatcatatcgatgagactgaggacctgacacgacgtgtaaagagtctggagagccgatgcaacaaagtaagccgagtagtccacatccctgacgccgattgcgatcctgttacgcagccgcgctctcgagtagttgtaaaggagagctaggctggtgagcaatgagtacattgcgagaaagtaactgctggcgacccttgcaatcgatgccagggccatggtgacggtgtaaaccacctgaatgccggacagagttctcagttcgttggttcctcgagtcgccttcctgtcatgaaacaaccactggaccgcaaacatgcctgccaagctcataggcccatagactgccagcggaagccattcgcgagaaaaccaggacatggtgggtttgacgtgtcgaaaaccgtacacagaaagaatcggtgccgagagcgccgccgcgaacgacagcattactgagagtacagaactaaatgtcggacgacttgctccgacggctattgtgaccatagccatcatcccgataatccaatgtgactgaattgccgcgtccatcgagtacgagacgaagactttgccaaatatgtcaaaatagacaacagcagaggtccgctccatgccatcgagctccacttcatccgccaaatacgtcgccagcgccaaagtgttttcacccagatgttgtggtaatccacgttccagattgcgctccacatccaagtgtgtatgatacaggtaactgttcttgtaaacagccatatccagtcctgtcagattgccgtactccacaaattggcgaaagtccgtgtcagagagaatgatgcccgtcgcaaaaatgtcgttgcccatggcagtcccatgtggatacggcacattgcggtatgcgtcgatcatgcgtcgagagttggcttggaacagaacctcgggacctgaagtcccgcaggcctcaaggttaatgacggccttgatagtgtgtcgtagctcgtggttggtgataaaggaatgggaggcatcttgcagggactcttctccgccgttgaatactagaataattggtgtgaaaatgaatcatccaagagcagctcgtcaagcaccgcgcaaaaaagacagcgagtagtaccatggcaggcaccacgcgtttttttgaggacttacagaacaccagactgttgcgtttgagtgccggtcgttgacttaggatccggatgagctcgagcatgacaccgatcggtaaggcatcatcggctgctccagggctaccaagagttgtgtcgtagtgggcattgaggaggattgcgctcttatcgcactctgggccacaagataggcgcactataatgttggtcatgttggtatacatcttcatgacaactaaacatgacatttccataaaaagcaagcgtgttaggttcaacaccacattgtgattttcagccctgcgtacaaatgcacgcacacatcagcccggtatgccgctaaaccaaaaggcattcccaaatcgaacatgcactacgtgctcaacggttccacacatgcatgcacgcacacataagaacaaacaatcacactcgcgcctctgttcatatcttcgaccggtttgtacttgacccaagtactttggctgacaaaaattagcaccctcgggttcacgcctccttgaccgcgtgatgcccatcatcgacactgattactgcctctaacgcccatttccccattcgtatggtcttgaatacctttagacataaagtcgaactggtgtgaaccatctgcgacctggatccaggtgtcgaaccgcggcaacgccaaagccgtctctcctacgcctgtggtcaatgaccttcgcagcctctcccgctgcgcatgctccttcatcgttgcaatttcttgaatcaagtagtcttgtgtttcctgatcctgcgcagtgcccacgatcctgtatccaatgtcgtccgagagatgtcttacaatcttgcgcacattctcctccgaaaagcgtaattgttgttgccatgaagcggggtcgagcatcaagccctcctcggacgagactggtgtcggcaaggagtagtggatccgatgcgcgagaagcaacaaagatatcaagaagccgagatagagcagcggagcacgggcggatcttgtgctccgactgtgcacctgactagtgccatcgccgtcgcccatgaggtgtcctcttgctttggcatcatccagcccagtcagtgtcgcatgcggcgatgggttgaggagatggccagtctccagcgggccgtccttggcggagtggaggtgtcgctggaggagggccggtctgccaagcgatgccatggcttgatgtgtgcttgatgtgtgctggatgtgtgcttgagcaagagggcctcgctgctgcggttggtggcagtggaaaatgaaggaataggggcggcaagggagggacggtaaaagggatgatggagtgccagacgcaacgctgggtgctcctcggaataggagaaggttggcagagggcgcacctgtggcctgtgggtgacgagtggagagtggagacaagagacagcgggctggtcgcggtggagcgcaacgagtggagacaagagagataaaaaggactcttgagggctttgcggactgacacgtcgtgcgagacacgttggtggcatctgcgcacaatcgtcgtctcacccactaaagtcattggacacacagaggctttgctggaatgcacactgaacacgtcccctagtccacagctcgcgtctcctaccagctcgcgtcctagtcaagcggcctcatccttagagctggcccggtcgccatgccgtgatgaagaatacacgaaaatcaagggggtgctcatcctcaaggcccttagcctcactcgatctcctccttcaagggggggacgcatgctgtcgtttctgtctcctgcgatgtatagatcgaaaaaacaaaactggactcccttcacgacatggctttcttcacggcacctctttttttcttcatcctcatctgcatctttttcttggtccttccttatccagttacttttttcaacatcaaccctttctacctttcacccagtcacaaacagaaatatgcaaatcacattcattctctgcgcggtccttgccttggcgacgggcgccgtcctggctctccccacctctgtacctctcttcaaacggatcttacccatgcctgcttcctccatgcctcacacctttcctcaagagtggccccggggtccaggcaggctcaagaagcgcagcccagtcaaccctctcgggtcagggtcctccgcggaagagtacatcgcctcccattcagtctcgtcttacaaccaagagggcgaaaggaccaccttgaaacgacgccacgaactgaaagaggtcgaggcatcagagcagcatctggtccatccaacccagaacaaggacccctttgaagcatactgaaggaaacaacccgctatcaaacaccttgattttttttttcaagttgattcaagatgcccaagtccaggtggcctggccacctcttctgtcaacgtttcgcgaactaaaaagaacactaataaaaaaatccagctgctgccataacgcatcttcatagcatcatgaacgcttgaaatgtcaccagcacagttttcacagcaaaacaacctcgaccttatcgaacatctgtccactcgcggatccgctgacgccccttcaagtctatacaaatccattattgaccccccgactctaagatatctgtctatactgtcaaacttgacaacgccaaaactcaaaaaatgccgcgcttcaatgctattcctccgactgtttgcaggccaacacattccactggatctcctgatctgcctgtcccttccgtcctttcttctgtctcttttctcgttatagctcaaaaatgcgccctaaacaccgtgagagaggttgtgaatcaaaaagtcagtatcatagccttgtcaaaccatatcaccccccccctctttcaatagccatgacaagacccgtgtgccgactcacttttccaaaaagtctccctcgttcccctcgccctgctgcttttgctgtgcttttggtagctgatgttgctgctgttgatgatgatgatgatgatgataagagtgggaatgctgatcctgaatatggtgctcatcggctgcgccagtctcgttctcctcttcctcttcctcgtcccctacaccgcggtggtgttcatactgtccaaaaggcaacgacccatacatgtgctgaggcggtcccatcatgaagctattgggatgggcaatccattctgacgggttaggataaccatgcccaatcgagctgtttccttcgcccatggatcccaacacattggaacgagggtgtcctaaatggtgctgctgttgctgatcctgataatggccataccccgggggcggtggaacctggtgatgctgttggaagagattctgctggtgatgctgttgctggtgctgatgctgttgttgggtctggccaaaaccagggtacatgtagaaaccgggcgaaaaggcactgctgtggctgttgatagtcccgttcctggatccttcatcctgatcagcatcatgtccaaaatcgcgtgccactgaaccgtcctccaggctaatacctccgttcgcaccactgcttccaaactggtatggactgccaccattgagcggcacaaacaccccctcgctgtcggcatctgccaagccatccgtggtgtcgctcaacaatcccgatcctatgccggtgtgatgttcattcagatgaccatgaggtaaagctggtttgccgatcggccccaaatgaggcaggaatggatactgctgcgcgggcgaccccggatgcatgcccgcactggtcgagaaagacactggagccattccaacagatacggcattaagaggcgtcagtccacctgaagacgtcgaagtagaatcaaactggggaggggacgaaatcccgctttgtgtcgcaactccctgcaagtccgaggggtggggggagccatcggcagacccatcccctgtggaaaactctgcttggttggaccctgggcccaacaaagtgggtgaaaagccactgccgccaaaaggaggtggtcccatgttgaaaggtccacccataggatggcttccaagaggcatcatctgaggctggtgaaagtttccgtggaacccgtgctgcgcgtgcattgggtgcatgcgatgtgcatggtggtgcggttgatgatgggcgtgcggatgagggtggtgcgaagggtggggatgaatcataggtcccatgtttccatgcatcggtggcccgtggctcataggactgaatcgatcataatgaacacgaagaacacgtccattatactcgtagttgtcaaaggtggctgccatacggagaagcgtagatatgtatcagcacaaaacctttgaatatcagcgttcggtaaatcaaaaactcaccgatcgcgatcctagcctcctctggcgttccaaacaggacggacccaaatcccctgctccttccatcgaagccgtgggccacgtctgctcgcacaatgtttcctgccctgcggaacagatccttgagatcctgccactggcactgaaatgggagctatgggtatttcatagagatttcgttttagtcaaatcatcagtgctaagcaaggcaagcacctgcaataaacgctcgctcatggaagaaatggattttacattgcccacaaacacttgtcgacccgctgcgaaattgtttgcaggagggaaattcctctaataaaacgtagacaaaacgctcaggcaatgagattcaaatgcttttacatgatgatcatccattctcatagatattcttcatacagtgtatggtccagagtggtaaggtcctggacctgaaccatgagacactccgtcctgatggcggccattctcctgtccagttctttcctcctgcacttgaatcacacgatcctgccactggtattgatcaaacatggctagaaccagcacccaacgaaagtacgagcgattcatggtgtatcagcattatgaggcatcatttcatgaaaaagaaaagcttttcagaccggaggacatgcgtcacatacctatcgcctttttggcctcgtcctcgttcataaagatcacggtaccaaagcctctggagcggctgtcaggacccatagcaacatctgctctgacgacatgaccagccttgcggaatagatctttcaagtcctgccacctcacccggaatggaatctagtaaaacatacacacgtacacacttgtcaacaccgatccctcaatctctgcgcaatgtaccaagcatacataaccgagtatacatacattccccacatggacagtgcgtccttgaactggctttggcgctatgttcccagagacttcgtctttgagtgcaccgtccttgtcctcagtgttcaatgggtcgtgctcatgtgcatccgcattaggcttcactgacagcttcttctccaatgattctgtgagttcgttcacatcctacgaggcaagcgcgttccacaggtggtgagttaaaggatttttcaccgtatttgtcctctcctttctccatttagcatacctcctgatgtgtctgatccggttttctcggcacgtaatcgacaatgcttcggtcctatttttttacacaacgaaccgccgaaaggtccgtaccacaaacgattagtgtgcggcctcaactgaactactcttacaagaatgcgtcccaatggtgggtgatagtaagacatacctctctgacctctagtggacgtccatgccactcgtaggcgttgaacatttctagcgagcagccatgtcaaaagtagtaaagaggtgagtatagaccattttgtcatgggtgcgttgacgagttatagcgtgcacatatgagagttaagccataccctgcgcctttgtggcatcctcgaccgtcgcaaagagaacgattccatgacccttcgacctgccatcgcgccctagcatgacattggcgcgctgaaccactcctgctccgcggaacaaatcctttcaacgcgatagattgtagctattagcaacctgaggtggaatttgagcctccttacttttgtcctacaggcttaccttgaggtcctgccagccgactggcgtttgatatacagccgaggtatgagagacggcatataaaaagcaaatttagaaaaagaataacgagcttgcgtcagacataatcgatcgtgcaagtatcaaggcctcgcatccctggtgttcaacaattgcgctgtgctgctgctcggaacagcaagctgataaggccatacccgaaaacggaatctacagtgcaggtagaacgaaaaaaaaaaaaaagcaatgctattagcacatttcgggctctgatcgtgcatgcgcgcgcttgcttcggttcaacaagtaatacataaaacgtgggtgcaaggaatcattcaatccttgacgcgatatgtcacttacgttcccgacaaaaagctgtcggccacgcaaactcatgatcctcttgttattgatgttgatatcctgtggtccgagggcttcctaggtctgaggtgaccttagtctgaatggtcaacgtgaatgacaacttcacattagaacggttctccaacggtgcgttcttcaaggcctagaggacgagatgcaagccgagaaaacgcgcagtgcacctacaggttaagaagcaaaccaaaaggctccgcgaagctgaaggctactcgaggttatgatggcgattccctgcaagaaaaacacttgatgggggactgatggggttgctgcagtgtcgacttttctcacagtgcgccgtcgaaagaaggaaagaaaaaaaaagaaggtcctcgtccagtccaaagggaaatgcggacaccttccttgttctggaagctgatgagagttgccgatggcgccaagaaggtgcacagaaaaggacgatgagaagcgagcggggctgtttcctttgtgacaggggtggtgatgtcgagcagcaggaaagacattcttggttctgagctcgctgtgtgagccagtggccagcggagcgtgactgttccggtaaagggttgggtgggtcattttcattttctatttcgcgaaacgagctatcgaagggctactgcaagaacgtcttcaagctgtcaatctgcgcctgcacagtgactcggctcgtgcctccaggggtgcaccggttctcaatgctctgctcaaagttccagaccttggacacatccgcctcaaacgagggatgaaggctcttaaagtcctccagcgacaagtccgccatcgtgcactggcgctcctcagccatacggacagcctcacccgagatgtggtgggtgtcacggaatggcacacctttccggaccaggtactctgccaagtctgtcgccagcatgtcgatgctcaagctagcgagcatcctctcggggcggatcttgagggtggcaagcacgcccgtggtgatttggagggagcccatcaaggtgtcataggcatcaaagaccggctccttgtcctcctgcagatccttgttgtatgtgctgggcgtgcccttgtacgccatcataaagccagacataccgccgaaaacacgtccagatttgccacgaagcaactcgagactgtcggggttctttttctggggcatcagactagatccagtgctacaaagacgaagcaagatcaaaataaagcaaagtcacaatcggtaggatcagtatccagcgaaaaccacgaaggattgcaaagtaggacagcagggcgtgtgtatgagacgttgcttacctgtatgcatccgccagttgcacgaacccaaactcgccagagctgtagataatcaaatcctccgcaaatcgactgatgtggaccatggtcagcgaggcccagaacaagaactcggccacaaagtcgcgatcgctgactccgtacagcgagttgggcatcacgcggtcaaagcccagctctttggccaaaaagtcacggtcgatctggaaggggttccctgccagcgcacccgaccccaggggcaattgattcaagcgatccaaaagctgctccagacgttgacaatcagcgtgccacgaccaggcgtgggccaaaatcagatgtgaccaacggattggctgtgcacgctgcaagtgagtgtagccgggcatgatcacatcaatctcgttttcagcgcggacgacagctgcaccaatgagttccttgagcacgacaacgagcttgcgtccctcgtcgcgaacccaaatgcggaaatcagtggcgacctggtcgttgcgagagcgtcccgtgtgcagcttgccagagatgggtgtaccaatgatctcgccgagtcgacgctcgttcgccgtgtggatgtcctcgtcgccgtcccgaagctggaagctgttggattcccactctgccaagactttgtcgagtccctcgtgcagctttgcggcttcgtccttggtgataatgcctttcagtgcgagggctttggcataggcctgggagccaacgatatcggctttgtagaagcggcagtcgaaggagatggaggcattgaacttttccataaggggatcagtcttgccagagaagcgaccgccccagagtttgcgggctgcaggagcgtcagtggtaggagcagcagacattgtgaagttggatgtgaaaagggcgtggatgttatatacagtggggtggaggcaacgactacaacggagcaagacgcagaagctggaaagagcgagagagggtggtgggagagggtgggttgaagcgagaaagtaaagagacagagtggcaaaggggagatggaggggccttttataccgctcgctgattgtacagcagccagcgtatctttccgtttctgctcccacctgccagcagaggtgtgagaaaatttaaagatgtctttaggacgtggtgtgtgtcagagtgcctcagatctgtgtggcccactgccagccttgggactgtcaaatcaaggtttttggccctttggctgtgtttcgctcttgttgactcgcgctgacaatcgcttctgcccctttgtgcatctctggatccaggacacgcgagcatgtccattccatgcctcgatccacctttcctctccagcgaccgccccctctgtcgactcgcccgcatcactggagtgcctctctcttcctggctcagctctttggcctgcctgcccccagaccggcccaccaccaccaccaactgatcaggtccttctccttgcttcgttcctccgccacactaccgtccgacgactccccctcatcaccctccagctctccatccggggagcgatgcacaccgcctgcgctctctgcacctttctcatctccgaaactacgcattcattctgcaggcgcaagacgtaataattcctactggtttcctgaagacgactcgcgccttcttgccctccgtcacaagggtctaccgtggcatcagatcggacaagccctcggccgttcccgccaggcctgcaaccgaaggtttaatgcggtgctcgaccccgaaaatggcaagcccttctggacccgccatccagagatgaatgcgatcctcgaaaccctggtagcacaacggctcggctggagcaagatcgcagactacatagggatcaacgcttcctcctgtgagaagcaatggagggaactgaaacaccagcaggaactacagcaaaaaagtcgtatgcaaacagagactgctagtgctcggaaaccacagaaggtcaagagcaaaccggtcaagcataggccgtttcggatgacggacgtggaactgttaaaagcagcagtcgcagagcacggaacccatcgctgggacaccatcgcccagatagtcttccagtcccgctacaccgtgcatcatttgcggtatcaatattccagactggaaagaacgcgacaggtctggaccctgcagcaagacaaccaactccttcaagtggtcgcacgatgggtgtcgaaagatcagcacttgagtcccgaaaaggttgacatcccggacagtcagtgggatgctatagcggatgccacccagggggaacataccggcgaggaatgtaggaggcggtggctaaagctcctgttgaggggatcaaaacgaatcgccagagctagagctagggacgagtcaaccccatcagcaaagccatctacagacgatcaagaaccaaaacgcgtcgtctggacaacggagcagtctttgcttctggagtctatcatccaagatctgaaaagaacccatgaggaccggatcgagtggaaggttgtctccgataggatgggacctggattctcaaaggcgcagtgcaagagtcgctggaaccggatgattgagcaatcgtcactttcaaagacgggctcatggaactctcaggaacttgagcacttgttctcgggactgttggcggtaggacccgcttggacagagatacaccggcaatggctcccagggcgctcaccaaagttcatccagggcaaatggaagcaaatccttggccgagtcaatcaagatcaggtcatacaacgactaagttggcaggatgcatgtgtcaactcctttggttcaaaagtgggaggtatattggaccaggcagccaggaagtggccaaatataaccgtggatcgaaaagaaccgaataaacaacagtaactggaaagtttggttatttacaaagcactctatttttttgtgtgttctttggttcttttcatcgtgaagacaagtacgaatgtatcgacgtacaaaaaatggtataatgggggagatcgggcaacgtagttcttactcgtctccctagcacttgctattgcaagtaaggacaaaaaaaaaaacaaatgcctctcctcatcgagagcaagatgactctacgcgacgtacatgggcaaccgcagggagggtggggactggaggttatgcagcactctcgttttcggtgatggccttggcctccactgcactcggactcatgagctttcgcatcttttccacctcttcctttgcgctggcgaccttcttttccaccgtgtccttggcctgatcgaccatcaactgcgccttggcggtcatttccttggatcgctgctgaatctcggcattggacttttcaataatctcggtcgacatcttttgcacttcctctgcccggaactgaaggtagcctgtggtctggtttgcggtgtgcaagaatccaccagcactcgtcataatggatccaaagacgttactgcaaatttacaccaccacaaaaaaagaagtggaagaaggtcagacagctgccagatgctgaacgcctctacctttgacagataccaacgcttgaagggccgaatagaagtctagatgtgatacgtaccgcacaacatggtcgtaccaccatcccagcaggggcatgctctgaacgatgccctccaatgtccatgaatcctggtggctatagatcatcagtccctccggcgtgtccttgaagtgcagtgttgttgtggctgggacctgcagatgcagcagggggaaaacgcgtggccgcaaattctggataagcgagataatggcagtgtgtccactgtcaaagatgaaaaaggatgagataacggcggtcagtacgcgcgctacacgtttctagtgcttatttcgagcgggtttaacaaaaaatcgttgcgtggtaaaaagacccctactcaaacacaatgttggtcacttcgggctcatccttgttgagggaggtccacacccggaagacctttcggatattataccgcccctcgactgtcaatgcaggatggatatatctaattttgaagagaacgagagacacagatggaaagatcgttagattgtctgtctcttgcgatgtccatcctttcgagaacatgccccttttgtctctctgtccatctctctcccttctgccctgtgcaccctcgtcaggaaagtctcactcactgcctccgtggaacatattcggcccagggtcacactgggccgaatatgtcaggagggggagaaacggtcaaagagaacgggcgaagcaggtcatttgatcgatcctgaccaacatccttttttctctttgcctccttcgcccatcctacatcccttgccgttgtgatcgacttttggcttgcttttgttcgagcaaagatgttcctccctactgcggtatgcgcagctggtattgctgtgccggatataatgtgatgtgtggagggcattatagatcacctactttgcatcatctgtgaaaaaatcctcaaggatctccttgtgcatgtcttcgtcgtagctggtcagccggttggcgagccaccatatgaactccatgttcctgtctgatgggcgtccaaaaaaaaggaagagagcgcgatagagaaagcgtgtgtgtgagagagaaagtgaaagtgaaggaggaggtgtgcagaaagtatcagttacggccagcttcatgacttgtattcaaggtcgcaaccggatagttggagcgaatccgtagcgtccgtgctaaaaaaaaaaaaagcggtggcaacttgccagcaatggccccgaaacgtggatggattccccagagtgctcacacgaattcgcgtgctccggtttctttctcctcttcattgttgcaccaacaacgtcaaggaggaatgcgccttgggaagcatgtcgtacctgtcaccacatcgtgattgttgctactgaggttgctcatgcagctgttgctcatgccgctgatgctgctcctggtcgaagagctatagctcctgctggaagatcccatgttgttaaactggagtggggttgttggaatggatggagctgatcaagttcgtgtggttaaagcgaggatggagttttcaggaacgaacgaacgaacgaacaaaaaaaaaaaaaaaaaaaaagtgagacggagttggaagtgaaacggacacacttggacaaaacgagtggggaaagcgagagaaagagagacagagagagagagaaagagagagaaagagagaaagagagcagaggcgaatccaggagacagagaaggagcagacgagagccagggtctgttttaaagaaggcagagtcgccttcgatggcctgatgtctgcccgctgcgaggactcaggcactgggacagttgtgcagtgtctcctccacacacaccacaaaatatgcaaacattgcatggatggtgcccatcctagactatgttgttgttgttcctctttcactatcccaaccccaacgatttcgcatcatgcttctctcaggaagcgatcgagaaggagcgagtggggataagatcgcaatgcacactcgagagagaaatactctgcatctgtggccgatacagctgtttacgagagaccgaaaaggggaaataagaataacgaacgcgaaaaaaaaaaaaaaaaatcgagcagccgatcagcccttcatcctttgtcgtattcaaaactcgagctgcattggtctcactcctgcggctatctaccgcgtgaaggattttcgtagcccatggctccaagagagagtgcgtgaaaaccatcactgcaaacgtggtgcacagtactgcgtttggatctcgcctcttcccttactgattgctctcacatcgcactgtgtgcatctacacgcgccgacatacaaagacaagacagcgggaggcttccacaaaaaaacaaagatggtcaactgagcaactttaaaatctgcggacgggaaagatggcggagggatctcgccagaatcaggaccataccatcctagtccttgttggccagccctacagcagatcgcgtcccacaaacactgcagttgtgacacccattgctcctgcgtgtatgacggagcggggggaggggggaggggggacaggacatctctgtaaacaaaactaagcctactctttacaatgcaaaacaagtcaagaaaaaaaatcagcagtggtgggaaagcgcaagagaggacagcgcactggcactgggtgtctgtgcaaggtctcgcaagcggtcaagccgcggaactttctcactgcatgcttacatccactcttatgacccgtctcaggtaagctcggcacacttgcatagcttcagtcgacagagcgtcggcgctttggttgcaaaccaaggtccgtgttagaatatcgtctgcatagcggtaaaaggtgctttaatagaaatacaaggatgagattctgaaccaaggtgctatatggaaaccaatcccctccatccacaatagagagaaacgaaagcgcctcattctctctaaaactacttgctaaacgtgcgcgctcatgccaggtcttagcaaaggtcgccatcaggaccgcatccagcaatgacctgcttgggcttgacaccggcgatagtcatggcagcattgacgagaccagcaataccaataccagcaatcagaccggcagagacagagtacatcaaccgttcgtgcgaggccttgctggtacgcttccagatctgaccagcagtccaaccgatcagcatagcaacaggaatagcgggcgaagggttgataaagccgagaccaagagcgttcaagttgatccagtaaggcttccagctgtcggggaggaacttgacgcggatcaccacgttgactatggccaagacagccaacacaagcgtcaagatcatggacgactgagggacggtgccatcgccagtcaaaatcttgcagaccttggaccatgcaacgacagaggggaccttgaaggggcaatcagtcatggtctcgtcgaggacgcaggggtaggcctcggtgtagagcaagaacagagggaccgcaatgacaatggcaaacgcagatccgaccatctgagcccacaacatggcacgaggcgaagcgccaaccagctgggcagtcttgaggtctccgaccatgtccacggactgcgagcaggctgaggcagcaatgttggcgcacatgaggttggtcttctgcacaacttggatgctggggtcagggatacgagagaagatcagctgagtgaccttggcaatggcaccagtagggttgatgtcagtctctcccgaggcctgaagtccgacaaaggccagcaggaaggcgatgataatggcgccaatggtggcatagacggggacgtggaagtaaaagtacatgaccaggacggtgaacacagccgagacaaagactccgctgagccaccatgaggtagggatcagctcatgctcgggggtggggtccttggagacaaagcccgaggtatcagtgagctgctccttcttggcgatcctgcgaatcatgttgcgcacctcgcggagaccggtcatggccgcaaaggcaagggatctgtagttggcaccgagctcagagaaggcagtgaaaaccatgacaccaacaccaggccacaggaaccaggactgcgcagaggcgatggctggaggcatggggaatccggtagggccagtcaagtatccagattgggtgagaaggggaccagcaataccaaacgcaatcaactcgcccaataggaacgaaaagacggtgtttccaggggtcatcaagcccgcaccaaagaaggcaaagtcccaattgagggtccatccccagagagcatcagcgttctgcatggcagaatagccggcggcgttaccaatgtaccacagaatatgcaggtcgttgaagataccagggatgaagaacccggtaatgtgccagagcatagagccaacgaatgcgatagccatggcgcgaccagactccctggcgtccttggcggcggccgagccagctctgtgcaagctcttgatggtctctgcagcggcacgaggggtggggaagaccaagtcttggttgatgacaaagtgggatcggagaggcacggcaaagaacatgccaaagaatgcagcggccgcagtccagagcacaagagcggcgacgtcgtccttgggagtcgagtcacccatgagtcccatgcggtacatggcggggatagcagtgacaaatccactggagagtcctccagccgaagtggcagcagcctggcagacacagttctccttgggtccaaagatcgtaccggtgacacgggccataaacttcaagatcaagaaaccaaagatggacccccagagagcagcaccaaaggtccagccgatcttgagacccaagtacaagttactggcagcaacaacgcagcctaggatggagccgacaatagccgcacgcctatttaaggtaggtcaagagtcaaatcatgaaaaggattagggttaaggtgggacagtgggaccttggaatcctcgtagaatcgtgggagggtggtatgcggggtgagccttaccaagtgaactgctcaggctcgtagatatattcttcttcatcctcttgcacatcgactacttccgcctttgcatctttctccgagggatagtcgctctcgtggtattcggcctttccgtcgacctttgtgtcggtgaccgggctggacataatgtgttctgggtgattaatggatcagaaggtatatggagtagtgcttggacgagagggagacgagggagatggaggagaaggaggagttgagggaaatgagagagagatgaaaggatgaggaaggataccgagggaatccaaaggtgtagctttgggtctctgtgggtgaggaggacgcagatagcgaaagcagagaagaaaagaagaataacaatgaaaaccaaaaacaacggagctaagcagaaacagcttttatttatatcacaccgggtacttgttcttcttaggaccggcgcttgaatttcttgggaacgcgtgagccaacgagcgtccgctagggtgactggatgtgtcacatcaagcaacagccaggggccccgattggctgtccatccacactcctgggaagcatgcttctctcgcttcagccttcactctccgccgtctgtctgtcgggcactcctgccattccccttggccctggtctacagtagtcatggttggtccagcaccttcctctccgtctcagcaacgttgtgcaggacacttattagctgcgctgcccgtgatggccttggatgcagatggcaatgcggtcttaacatcactagacgtacacgtctatatgcgcacgtctgtagtggagacaccaacgagtttgctgaatgctggcttttgacaagcacttggcaaatacttcagcgattgcaccatcgtgatcgaggccggtaggcgccttcacagcgagcgcttgtgtttctactctctttttgggttcctttgtctttacggtcaccgctgcatcggctccatttaaaaacgctgcagtgcttacaatatgggtggtacagcatttgtggcgtggtaaataatgaagtgctgctgcgtatacatacaaaccctgtgcactttcgcagatccaaacaaaaaggcgatcaactcaacacagagattatatgttatgatttacagtaaatgcccatggttgggcacaaacaggcacggaacatttcccgcgtgcttcacgggtgggtccagccagcttccttctaatgattaaagttttatgtcggtattgtatacccttgtactcatccgcctcatcgacaccgcagcagcttgtaacactctagcgaggcacgagtggaatagaattaactgataatgcacactgttcgtcgatccatgtgcgctattaacaacagcagttccgacctcaatcggctgggcatgagtgaatctgttttatggccccgttcaccgttggaaagaactgttacggctgaagaaacagagcgcacgcgagaggcggctgtccttgctcggtatcgtggcaattttgtacatgacggttactacataaggcaaccttccgcctgccactccgtacaaggacacgccgagaaaaagaagcgcacgccataaatgcactcgaacagcaccattttgtgagcggggtttgctgaacaggacaggattcattaccgggcagtcgtgagaaagcgaaaatactgtaagaggaatcctcgggtagccggccgagtggagcgggagtagtaaaaaaaatcttagttccgctagatcatttctcgtctgcgcatgctgagagagcagactaaaaagccttggacggatcactggcctatggcgcgatcagagttcagcccctcatcctctcactttgtcgatttcaccttttcgctcgctctcgacgcaaccctaatgagcaggtgacgctagactatggcgtaaactgcggcagccaatccaagggaatttgtaggtcccatgcgcgctccctcggaatcaattttccctcaaggaagcgcacctcgcatggcggatttaaaactctatagtcattgtgcttgagaaactgtttagaaccacaaggaatacgctccgagtgagctcatggctttcaagattactgcatttgcaaccatgtctcggcaaaggcggatttcctggaaggccaaaattaccaggacacgctggcgcaagtttcattcgcgtggagcaggagaatcacgactcatgtcatacctacccccgtacctggctattgcttaaaaggcaggctgtatttcatctagagctagcctttgatctttgaactgagtatatcgctaggcgccagggtgcgcttccgaatggcggaatatttggacgacagtggtgttgatgttgatattgctgatgaggacgaccagtggtgatgcctgaagtctcaaagacttgtcacaagcctgtcgaagatgagttcagaaagtgctgtctgcctttaagaagcggcctgtacattgctcaagatctcgagatcgttacatcatctgcacagggtcttgttcacgaaatctgcttgctgaacactcatggaacgtcttgaccaggaatcaagctcgttggtttcataacgattgaggcgcagggtgtacacgtccaccagacacaattgtagcatctcggtccgtgccacaccgatacgcgcacaccgcggcaccatgtggggaccagagagcgttagcacatacaattgaagcagaggagaagttccacggcgagtgcggaaatggtacttcacgcggcttgctgtgctcctcgaacgaacaagggcttaggtgggaatagtgcgcattctggttactgacctcactagcacgcgtattttagcgcgagacgcgctagccagtgagaggacgacggcggatgaagaacatgcaaaaaagaggaccagttgtaaatgcgttcaggttcagagggaatgaaaatgacctgacctcaggctgcatgaaaagatagcgcaaaactgctgtgcgaccgaccgatggattgtgagccgtaatgctctctttcctctacgccctcacaatgaagccacgacttcgcacacctgtctgagctctcctgcattatatagacgatggacgactttgcaatgccctgacgcacctttcctgcttctgcgcatcagttcattccattcctcgaccagccagatgctcttaccacagttttctaaacgcgtatcaaacagacccgtcgtagtggttcttgccagtgcggttgtcctgtgccaaatctgccaggtcccctacgctgtgacggcctctccctttgacacgtcaaactctcaacagaatgcgtttactcgtcccgccgcagcaccagttaccgtatgtggacccgtcattggaatcggtaactcgcattcactttcgtggtcgtagcttttgttaattatggaagtggcggggctgttgaaattcagaatcacgcactcacccaccgttgcatgtctaacagactttgccgaggaagagttttcggtagggtttgtcaatgcagcagaccaggtcgagttgatccgcaacaaggacggcgacatctacacccctagttacgtccgcatctttgactttgaagacaacagaaggcgcaaaattctttttggcaaggatgccctcatccgaccattgactaagcgccaaaagaagttgaaaaacgccatggattaggcgctgatgaagtacagcgtagaaaatccggtccgaaactacactcttcctgttcccgatatctattaccgattcaaacccgaccgagcctatggtttaggcgagttcgacagcaccaacatccaacaattctacttcagggccccgccttcgccgtttcttcacacggcagatggctttatggttgtcggagacgagtgggagaatgtgtcgccaaggtcgtatggagatcgtggtgatcgtaactcagctggagagtgtccaggccctacggacgcgcaggcagagtatgcgagaaggatgacggaaaaggcagtcgagaggagactgacggtcgcgggactgttgatgggacaggccagggaaatggctgagaagcgcctgaaggagagggtcaagtttgcagttgtcaccgttccctcgccgctggacatttcacaaagcaaacaattcgcgtccaccccaccggtgccgtctactgaaggcctcgtccgaggaggactgcacttcctccgaatcttggagcagtcggaggccgctgttttggcatacgagccccagattgtgaaggcagagcaggcatcaagcgggagaccgcaaatcatcgtgttttactatctcaacatctacggcgaagggatggttgtttttgaaaccaagcgcgactcagcagcggaggactttcttcgcctgaaaaccgtagccaagtaccatttctaccagtcggtccgtgaacgtatggcaaaggctttggcgcagcacatttacgaacagtatcaggatggctcgtacaagtcactggacgcaccacgcgaggactgtgaagattgcgaacaatttcaggaccaggaccccgctaaccccaaagaacagaccctgattgctctccagagggagattcatcagctgtcagacgactctcggagctggcccatggatgatgcagagaacgatgcaaaggaggagcggttctttgtctcgacgacggagtacgtggtgatgacacgccagcagtggagagattttgagagagcatggctgaagacacattttgctgcgatgctggatagagcatatgagaagagcggtgtcgaagtcggggcaagaccactgcggattgatcatttcttgattgtggacgagtccagatatcgtcaacggacctcgtcgattatgagggaggctcttggaggtagtgctgagttgaatgagctggttgatccgacaattgagcacaagtttggaccgattgtctcgcacggtgctgttcgcgttgcagactaccttaccaagcgctcctcccttcactcatgtctgtagtgtattccgaatcggcacataaaggaaatggcaagcctttgagtctatggacggtattgttgctacagaaacgcgtcatgttcgaagcgcgatgtggttgacgcgaaggatcgatgattgtgccagtatttccatgatggtgctcaagtgaggaggcaagggcgcgttgaagcatcatcgcacagctttcaagaaattgccgcaggtgcacaggccgcagtcaccactcactctccagacctggcgcaatttttcttttctcgcttctgcttacttgcacacactccacattcattccatacccacatgacgtccaggcccgttgattttctcctcgtcggactcggcaatccaggctcagagtacacgaccactaggcacaatggtacgcatcgcacaactcgacgaatcgcatgggagaaggaatgagatgcagcaatcggcgcgatcaaatcccttccagaaaactcatgcaacctctccacttctggcgttaaaacacggcttgtctgaccattttgaccctcctttgtcccctcggtcccctgctcgtaatgctgtcatagctggatttctgttcacggactacctcgcgaatgtcattgcgatggaccagaaaaacagcgtcccgcctgtctttcaacgcaggctgacactttcaggtaccacactcgccccgcgtcctggagtgcctctgagaactctgagaagcacgctgatcgattctcgaactcacatttgcacgacatatttttgcctcagcggatgtgcacgatgtcatattctcgtatcaaaagggcaacgtgtctgtaagtacatgctggaagcgtgttagcaccaaatcattcctatcacaagcgcgcaccttcaagggagcatgctgacagtttctcgtatcgcgttgaatcaaacagaactcgctccgaatcgtccttgtcaagcccttgacgttcatgaacgagtctggcacggcagtcaagaaggtcatggacttttacaacatctgtgatcccaagaagctgatagtcgtctcggatgatattaacaccttgccaggagcgctggctattcaaggtacgtcactgagctttatcagcaaccaaaaaaaaaagtggcaccagcctctgtcgacatgtaagcgcagactgcgtttgtcatactgacagtgccaacattctcttggggcggcctcacgtttagatggcggcgatatgaagagtttggctggacaaaaaggacaggaaagcattgcgaccatcttgggaaccaccaatttcatccgcttccgtctcggagtgggcaaaccgccgtcaggaagccccatgaccatccctcagtgggtccttggacccttcggccaggagggcaaagaaatggtaagtactggcaacactcgcccttgggctctatttccaaaatcgacggactttctcagaaattctgacccatcactttttatctgtcccgttctcacaccaggatctgtttgcctacttgatgggacatacaactcaggcattacttgactttgttcagacaaacgacctcaagtcgtgcaggaaaaagtttacaaagtcgagaaaaattccttcggggcttgttcctgtcacttgcattgagagtacagttctgacggagggtatgtaagaatagtgctagacgaaccataaagaagcagctcagcaacagatcagactgctccccgctctggcaaaatggatgcatgccgacgcttcttcaaaagaccccacgggtttggataactgcaatttcgtcacatcaggtggaatatgtagccatgatcgtactatgtctcaccaagacgcgcctccaggacgtgatagtctacgacattcgaggacaaagttgacgcgtaccatcaaagtaccaaaatcgtatatacgtccccttcgaggcctcgagcaggtttattgaagttaaagagtgtagataagagacccatacgaatcgtgtcctagatggttctcatcagcaaaatcaaactcaagaacgactggtgaagatcagtccagtggccgtgggctctccaaggcggctacgaagcacggtcttgagcttcttggggtcctgaacttcaatcttggagtatttcgaaaccatcaggacaccgattgtcttgagctcttgcatggccaggaacctgcctgggcatgcatgcctgttacgagaaaaaaaaattagtggtagagaaaggtgagaaaccaataatcacaccagtacgcacaaagaaaaatgaccaccaacagtatcgcaagcagcaaatagaaagagtcactcagtatagtaccttcccatgccaaacggcaaaaagtcgaccccaaccttggttgccggtttggacttgccaacgaagcgccatggcctaaactctgtagcatcctctccctgatcaggtccttgatgagccgaccgcatgttgacaatgacattgctgcccttggaaatcacgataccgctcgacaacttgacggtcttgcgggcgaggtgcatcagcgacagtcgctccgttcgacttcggaacacttctctgacaaaactatccatgtgcaccatcctcttgatggcagctgctgacagatcccgatcatgcgacgggtccagatccgcgtcgatagtttcacctttgctcaaaagttcttgtcgaagcagttcacgctcctgctggacggcgtccagcacctgcttctgctcttccagcagcttgtccatgtactgtgggtaggcagccatgtaatacaacaagttggtgctggtatcggtggtggtgtgaacagaggccaagatcaggatgagaagatgtccacaaacatcctcgaggtccacaaagttgtacttgtcaaagttgtccagaaaacgctgcatcatgtcgtccggacgctggtactcgatcccttgctcgatagcttcaacctcctgccgacgacgttccagaatcacaggtgtagccgcatcgaccaacacctgaacgtggctttgcatcgggttgaggacgttgatctcagtgcgcttgaggaacgtatgccaggaagaggtgcgacgaatgccgttctcaatcacctttccaaagtctcccgcgacagcaatgaaggtatcgatcaccttgcgggacttggcaatctctggcccaacaaaaacattagccactatggaatgatgaaatgtgagttgaggggtctcgcgcggtgagttacaaaaagagaaaatatgcatatatcgatcggatctgcccaactcatgcatccaaaagaaaaagaaaaaaacttacttgcattggccaccatttcttgcaaaaccagtactggcttttccaccaacttcccgccctctcctgctgggcaaacacccagttccttctccaaatatttctccagctccttgacgattcgtggggtgaacaaagacaagttgggcgagatattgtccctgacaatttcatgaattacacggctgtcgacctcgcgattgctcttgatcatagacataaggaacgttcgcatgcctgtgagctcttctatcgcatctgaagatgaaaagtcctcgttcaagaagacctctcggatctgagtgcccgagatcaccgtgtaggatttgcccctgtaatagatgttgaacactgggccatattcttcctcgcagcgttgcaggaatgcgtcctgatcctcaaagtactctttgtcgtgggttgtctcgcccggacggagggaagccattgggatggactgatttcatttgcaaagcaagggggccagagtagtaaggaggtcaggatcgagactagtaagtaaaggggggcggtcgaggaacacaagatctttgctcgttttttcttcggacgaaagtcttgtaaggtttccgagctttaccttgtctgtgctgaagccgctgcctgcagtcagcttgatggtgaggtaggctgcagaggcaaggccaagaccgaggggaatggctactttgagggcatctgtaggagccatacttgtcgagccagaaagcagagtgagcatgatggctaaatggtcgtgtgtaacaaaggcgccggactgaacacaaatatgatgtggggtatgagagtttgagtttgtaaagctcagcacactgttttgtttttggacggatggagagtgtggaaattatcgcttggacgtgtgccaacgtgaaagggtaggactgtttgagagaagaatgatcaagatggtgatgactgtaaaggaagagaagaaagaaaggagccaggtcgcatgccttatataagaaactactaccagggaaagaaaaaaaaaaaactgcaaatcatcattaggagagcaatccggttttttctcttgcctcggcacaatgcaaggaggcgcccacaggactgtttgaactgtggtcagactggcgctgcgaattccaatggagcgcttttctgtcgctaaaagtcgacaaaaatgcgcaatgcacaattcgactccttcatcatcgggtcgacacgtagcagggggggcagtgacgaaaaaaatccccccattcacccaaggcaactaagcataaaggcattaggcgttgttaaccttagcatgttcggcgcagcgtccttctattctatttgctcgacgccgcttcgtcatgccatgtcaggtcatgtctcctatcttcatctccacctgcctcaggctgtagccaagaacaatagactctgcccaggggttacaagtggttcatattacttggctgagcgactagttcgatgctcgtgcaaatcaatcaactccccctttccttttgccaatatagtttacggcagataccttgccgtatgcgtgggtaaaaggttatcccatttcattcacgactgtggcagaaggtgtcgtgtccgtgcgagtaccaagcaaaaaacacgggtcttgtcaggcagcgcgcatgcaacccaaatctcctaatgctccgagattgttcctccactccttgtacgacccaaaggagcgtacttctgggtgcatgattcgattcggcgtgagcgtggtgctcataagacctgcatgtgtggcgacggtctggaacagatgttcacccagaaaatgcatgatggctgaaggatgatggtgttcgactgcgtcgaaagaacggtgatgagaaaagaaatcctgatgcgattaagcgttaggggggcctaaatttgcgcatgaactggagttacactaaagccgtaaaacgctcacgcaatcttcgcctaaacgctcacatgcacccaagaattcccccattgacgccgtgagcggtaatacagcttcgtcgcaggcattgagcgccttccgcagtcgattgcactgatcttgcaagcccactcaaggtcagatgaaagtaaatgtttgcgcctcgaaagcgtgcacggtccaccggatgttggcgcctcaagtttcagacgacatcaacatgatcacaatccaacattagagttcattatactgctatcttgttcaagcgtgccctgtcttcgctatcacaggacagaggacaagaaagaattctactcctcggctttgacgttataggtccagttgacctctccaccaactgcaacgccccaccgcttgtacaggtttacagctcggacgtaaggactcaggcgcgtgtactgctccctcaactccttggcaatctcgtctctttcgtctgaatttttgcctccagcctctttgatccaagcccgggtcatgacatcaaacttggtttcgagtgcctgcctctcgttcaacagctcctccttctttgtcaagtccttcatgcagtcattctcaccctccgacgcagggacatactggtacttccagtcgtccaggccatcgtaatgggtgatgggtaagcgctcgcgaggaatgaccttgtgcagctctgcattgttacgagtaaagacaaacttggtggccaccacggggtcaagcaaaggctggattagcttccatagaccccaaaacacaaagggtgctcgatggacaacacacactccgagcgtctctgggtagtaggactcaaagcactggacaaaaagacggacaaagccccagtccatgttgtcaagaccaaagttggagaggtcaaagatgacaatgacagtttcggacccaactggcaggactgtgcggccacactccattgtctgttcaggcacgttcatcaaatatgaaatcgaaagtgtcagcgatgttgtgtgcaaagcacgaagaatggtctgggaggaggtacacttgctgcctggtttttttttttagcaaaagacttacataaagtgtgaagcggtggatcgtttcagcaggctggtcagccttgtggtgcagacgagtattgaccacagacataggacgaccgagaggatcagcgccacggaggtagccctttccgatacgcatctgttcaataaactttgggtatttcgcgtccagttcctcatcggagagctcgaccagctcatccagacgctcaacaatgcgccatttgagagcattcaagaacattttcaacgcatcgtccaacacccacttgcgtgcgcgaatgaactatgaaaggtaagggtaaatgaagccagcgattagcggatgggcttcagtggagtacactccttctgagtatctcacttttttgttcttaccttgaggacaatcaagtcaggatggtccatcatcgtcagcttccagaaagttttgtacaaatctttaccggtgaagcggggcgccacaggagcagtgctggtctcggaggcggacttactgcgcccaaaccagcctgacttttgtgcaggggcgccatcgccttcttcatcacgagcctggcccttgaaggacgacggggcagtttggtcgaaaggtgtcttgccatcaaagatgtcatagagtcgctcccaaaactgcttcaacttttctatctgttcttgattcaaatggccgagacgaccttcagtggggatgacgggctggacgtatgtagggctcaaagacatggcggattggaaatgtgctgatagaggggagagagatgacaagagggagggaaagaagtgaagtgagaagaagaagaagaagagggaggaaccgacgatcaaaaagaacttcttaacgaaacggggcgcatctttagagccgaggactcaacagaaaacgctcaagagctgcttcttggctgtcggcgttgattttctctgctggaaaagagttgtgctgactactttgtatccccaagcttcacttgcctttgaattgtttgtttgtccttctgcctgcgtcttctccattagagttaacatttgtttgttccctgtgttcattcgctccttctccacattgttaggtcatgacactttacgaccatggtttgcggcgggtgatcgagggtgttttgcgtggaaggacgatttggggcttcttgtatcactttagcggaatcctgtcctagactaaacacatgctcctcaagcagcaatgagaaagagagaaaaggaataagaaaaggccaagaatcccagtgagaaaggccagtgcgatggacattttcacccttggcatgcttaacctctctatgtatgcgcggtagcggaatcctgtcctagactaaacacatgctcctcaagcagcaatgagaaagagagaaaaggaataagaaaaggccaagaatcccagtgagaaaggccagtgcgatggacattttcacccttggcatgcttaacctctctatgtatgcgcgggagaatgcattttttttcttttacgccctcgtgcttcgggcgtcgtaacactttgcacagaaaaaaggttcggatgtcctcgaatgtgtgcacaacagcatggattgattttttctgagcgttgactttccaggcatcaagcgacgttgtgttcttcgccgcaaagagcccctttgtcaagtccaagaccacctctttgacccgaagcacataaaccctgtggttctctcagaaatcaagtatgagggctgaggttgagatgtgagatgcaggacgcgagatgcgaaggtgggattttgagaatcgatcaagactctttgtttgaatgtggagatcttcagaccctcagtgttcacgtcgttgcgtttgaatggccagaatgcaaactcatagcgaccatcgtcgcatgctgcccaccctccctcatcgccctcaatatccagtattgcacctgggagggaatctacgacgatgagtaggagaaaactgcgaccgattgggaagccgaggtggaggccgtcaagcgcttgatgcccttgctcgatgaagagactgaagtgcctatcgtgccaaggcaaggacatcttgacagactttcccatctgcatgctcccgaacttgaaactctcactctcgaggaggtactctcggtcttcaagcaatgcccaagcatcaccgatatcttcagcttggagctcagcggccgcattgaccctatggatgtcgcagagtgcattaccgagaactgcccaaaagtgaaccgtctgacacatccacatgtccgagtcagtttccagttgatccttaatatgctgagcattttacccaccaacactctcgaagccttcgtatgctgcgcgccggacaattcttcggctgacctcgcctcccgcctcttgaggcactcggcctcgctccgtgaaattcaattgaaaacccattaggaattcaacagcaaggccttccagtcgatcctcgtccattgtcaagatgtacgttgcagggaattgatagatcccgctttctagactatagttttcaaagtattcaatagcaacggcagagcactgaagaagagttaggcgacgcgctttttggatgtgtcgattcccgcccgtgagagtatcgcgcaagagcggaccagtgactggtaaggtctcagtttcccacgcacgacgaaggtatgtttattttttttcctgccccaagagtttgtcagctcctcctttcgcacacctccacacccacctgcgaaacaacgtcgtccacgttcatcctccttctcgtcctccgcccgtattccccgttgctgccgtcttgttgaatatgcttcgtcgcatcgtctctccctccagcttgaacatcactcgccgcctcgttgtctcgcccacctctgccattagcaactccaccagaacaatgtccaccaccaaggcccaaacccaattcaaccaggtcctcaggaccgaaatcgagtccatcaaggccgctggcacctacaagtccgagcgcgtcattgtctctccccagaactctgccatcaaggtcgctggcaaggacggcaaggtcactccccaggtcaacttttgcgccaacaactatttgggcttggctgatcaccccgaggtcattgcgcgctcaaagcactttttggatacccacggatcgggcctgagcagtgttcgttttatctgcggtactcaggtatggaagatatatgggcttcgtatagccttttttttttctagagaggcggggggataaggggggtttttgacgatgatggctaaacagttgcgtgcttttctgtgtcaaatcttaacaggacatccacaaggatcttgagaagcagctcacaaagttctatggcacagaagacaccattctctacgcctcatgctttgacgccaacgctggaatctttgagaccattctcacagaccaggacgctgttatttcggatgccttgaaccacgccagtatcattgacggaattcgtctgtgcaaggctaagcgtttccgctacaagaactgcgatatgaacggtacggccatactccagcaagccgacttttctaaacccgacatagagtcgtccagcattggatgcattcttttctctttagactggatcagatgaactaactatgatgttcatgcgcatgtcaaaaaaaacctatagagctcgaggcccgtcttcaggaggctgacaaggctggtgcgcgtctgaagctgatcgccaccgacggtgtgttcagcatggacggcaagattgcacccctcgacaagatctgcgatatcgccgaaaagtacaacgccttgatctttgtcgacgactgccactctactggattcttgggccctaacggccgtggtactgcagagcattttggtgtccaggaccgtgttcacatcatcaactcgactcttggaaaggctcttggaggcgccgctggtggttacaccactggatgcaaggaaatgattgaccttctccgcaaccgctcccgcccttacctcttctccaacagtttgcccccagccgtcgttggatcggccagcgcggctttggacctgatcgagggcgccaagtccaacggcttgtttgatcagttgtggggcaacaccaccttgttccgcaagctcctgagcgaggctggattcaccatcaaggtaaccaaccattgtgggacccatctcctcatcatacgaggtgctatgtatggcgtactctcttgctagatgttcgcccgaaaactgacgcattcaaacaatcgttcgtaatattagggcgataaccaccccatttctcccgtcatgttgggcgatgcgcgtcttgctgccgagtttgcggataagatgttgcagcgcggtatctacgtcgttggattctcataccccgtggtccccaagggcgaagcccgtatccgcgtccagctctcggctgctcacactgagaagcagatccgtcaggccgccgatgcctttattgagatcggtcgcgaactcggtgtcattggcgccaagagcaagctgtaaattactgcaacctcacgacacctccttccctctcactcactctctctctctatctcctccatcgccatacacagctcagcacattttaaacttactcaatacattacaacatgttcatcaaatcctgatcctatgggtatattactattctttcaagccctattcctttctggtatgaagcgtttgatcccaatctctgccactttgtacaacggcagtgctgttcgtggatgcgctagctgttttcttgtcgcagttgaaggcaagacgacgtgacacagaataaccgtctacatcccgcgatttataggaccgatgataacgtgagggaagggttagtcatcagaaagcaatgaatctatgctctttcccccatcttcgtaaaaaaacacaggcgtaccttttgaacctgagcaatgactcgattcagggtcagcagccattgccaagaatagactgcatgcggtacgcacattccgggactcggtgatataaacgacgacgacgacgacggccgtagtgctgtgccagtgccaaaggatcccttagcgtcctgtgctgcttcgcctccgatgtccgaatctgcattacatggaacgatccggactgcgtactgcgagtgtccaaagacaagacccttcttgtagagtaaaaaatccgctccgtatttaagaccgtccttgacaatccagccctggctccggtagtagtgatagacaacatatcggaccacaaagcggttttctggtgtcaaatcaaagtctcgagtggataaagtcaactcctggttcagcgcgagaaccgaggatgcctctgcgaaacgtagccagcactcctggatggacatgacgcgagcgcgcttgaagtccctgttggttaagtagtcagctgcattaggtccagtggcgggagtcgagatggtgaggcattccacagcaaacactagaaagaaggcctcctccaacgaaagctgcagatgctcatagtcttcttcgtcggtctcctccatctcaagcctgggggtcgattctgtggatgacaccttcgtatctggcgactctccgctgtcagctggaggcgtcgcctctgcggataagggcgtagatggcggttgttgttgtggaggtgttgcagtagtcatcgtcacatcgccttgctgcgcccggagttgtttatctctccgtagttgtgcgcgctcgatccgcctctgtcgggtgaggtcttcgagtgaaatgtctacttgatatcggagagaactctgccgtgagtctttgaggacaagagcagatgcactcgagaagcacagatggtgttcgtcttcccttaccttgcgaacccttggtgttcctctgcttccaagttgcctcactacgcgacagtgttcctttgccaaagaagccctgccggaagagcctcgacatatcctggtggtgtgtcacccatactgattctccgccaggatgaaagtcggcctcaatgagattcagcgccccgcggtttcttgattcagtccaagtgaaaagacgcaagaactgttgaattgcaaaaagtggtgaggaccacagtgatcgacattgctgctgcttctgaagttgaacttgtgcctgcagacagggcaagggcaagggagtcccgtactgctccctcttgagtgcattgttcttctttgacatgtgggcttttgaggcgtcttgacgaccggtgaatgctgaagagacgtgaaagccttaatttaattatcatacgtgcagtgcaaggagatgtattttgtgcgatgtggcggagcaaagggaaacagcagacggttttgtgctgtgtggtgttgcaattctagctacgggtatagaccttgacaatggagtccgcaccgcctgtcgcaagcaagcccggcaaagaaggatggtactggactgtcgtcacgccctcgtcgctctttcgccggtgtccagaaaactcttgcaagcacgaccgcgtagacgatgaaatatcccacagtcggacagacccatcatgccctccagagcacagcaccaatcctgaagagtcgatatccagcgatgacaccgcatccaaatgagacaacatcgagaaagagcacgctccagagttgatgtcaaagaagcggatgtagcggtcctcatgcgccgagacgacaatgggcatggtagggtggcagacgaccttgttgatctgcgtggcagcggtgccgtctatcaagggaggaaaagaaatgtggaggctgttagctacaagaaaggcacgttctgtaaggtctcctcgcccttcgacttggcatgcatggcgcgcctaccataagactcgtcgctcttaaatgtcagaatctctttcccagtctcaatgtcaaacagcttgatgacggagttggagtagctgactaccattttcttcaaatccgttggacaaaagtcaagccctgtgggcacgggcagcttggccaatccagaggtgtaagcttccgttggttcagccaactctgatgcttcgagtccattatacccccaggacgatcgcagtggtgatccctttgtctcggtgtcccagatcttgagcgcaccgtcagcggatatggatgcaagcagctgcgaggaagatatggagattgggaagagtcgaatgtcccacaccgagtctgtgtgcccgatgaatgaagtcagtggtatcgttgggtctaaaatggaagcaaattgatctaatatgttagtatcgacagctaaaaacgcaggttagtcctgatatccaatactggctaaaatgccttaccaaggcgcgcgtatgtatccttgttcatggggacaagtttccatgatcgaaccgtagagtccatgcttgcagagaagcacttgttttgatccgccgagatggccacagatgtgattgcttttgtatggccacggtaggtatgaatcggctctacctccccgttgagtggcctcttggaatctttcagaggcgactccaggttccagtacttcattgtgccgtcctcggaacctgataacaaggccttgttggtaggatggaatgcaatcgagcgcacggtgtcaaagtgcctaaaattgtgcaggattggggttaatgacctgaataggggggggggggggggaggttcagcctgatgcaatctaccagaatgccaaaacgatgcaacacgaaccttctcagagtgactttaggtcgccagcgcgcaggctcgtctggcaaggcttctccattcttggtaccattactgatttctgactcttccgcctcggcgacgctaaggctcgccagttcgtcaagcatgtctaaagccatgaaaaaaaaatgaaaaggtaattagttataggcgcatgttatatgactgactctgatggagcaaggaccttgactggtttgaacaatcacttaccgctgtctttgttcttctttttgtgaatcgagtttttcccggcgccgacatcctgcttcaacttatccctatcccattccttgaccatcttgttcaagcgctctggtgatatgttgaacttgtcctgcacatccttgctctatgacaacagaagaacgcgttattcagcaggaacaggaagtgccaacggtgatagtagatataaaaatcaaaaaacatcgtaccagctgggcttcgtcctccgccttggcattcgccttctttccttgagtcgctcccagctgcttgcctgctttctcaaggtctgcgcgccactggtctccagaaaggggagcgtgcacaacggtgatggcctcctcttcctgaaaagcatttcccagaccgttcgacatctcttcgtccagttcatccgactttgtcctgctcttgttgtcactttgctcacgcttctctttcaaaggctcctcctgcaaaattacgagtgcaggtgcattcttttgagtgtctacggtaacaactccgttgatttgcttggaaggctgctggacgactgtttgctgcttcacagtagagtattctgggctctcatcctccagtggtccagctatgttactgacgactgcttcctgtggtaggttagttcctccctgcttatttttcgcaagagactgcaacgtagcgaaggggacggaattggagcggggtagaggcggtggcaccgcagactgggcgttcgatggaaagaaatcactgtgtctgtgtttgccgccgccgccgcgaaggccattcagacctgcagccctcttatccgactcgtggcgagaaagacggttctgggctgggggtacagccattgcaatggactgaggaactgaggatgtcaagtagctgatctcttgcaaacatctatgacaatgatcggggcggtgaaatcaatatcagtcatggtccagggcgggtatattaggcatagagctctgtgaacaaaacaaagagtaaaagcatgacaactctccttacattctaagaaattctctgctcttggctctgccgacaggatccaggctggttgcagaggtagggctcacttgggtcatattactccccgaggtgctgtaggtcgacattctattttgcgccttgttgccgccgttgctcaaaagatctccattgctcgcctctatgaacgtaaccgaaaccataatgcggttagcagtgatgtaaatttagggcagccagggcctttacaaactaaggagagacacaacacatgacagtgaaccctgctaagaatattcggatcgattgagggagatgacaacgatcgcgcctcattttcaccctccatcgtttcacatgcgatcggttatcaggaatgtgttatataagcatgagctgattcttacgtgcaagatccggcgagcctatcacagcacccttggcaccctccacgtatttgctcctatgccatgccacagaacacacaagattactcgtcaacagcaagttgtgacagtacgattcacacaagggactacagatgaaggccatacggccatatgactgtacatacctttcctgtctcagagcatactccaacatcttgacacgcttcatgaggtccatctttgtattatcaacgccacgcttctcgccctcgagaaaagcaattctggcctaaaaatgacagcgagttgaggggtcagttgcactgcatcgtcatcgtttccctcgagtgcagtgatgcatatcgcattcaacgcttgttggcatgtacaaaatgcacctaatgcaatgataagcgcattgtagaggatctccttgctgctgctgctgctgctgctgtttcctttggctgctttgtccctcatgctccttactcctaaaggcctgatacttttttttctccctctcttttgctttgcttttgcacgtgtagaagggtctgggtgttcagttcttggatgcgtaccttcatctctgccttttcaatatcccattcgttcctatctcgctcgaagcgacgccattccgactgcagaaactgcagcacgctagggaaggcatactcggctacagtcggtgcttgtggaggaagggactgaaactggttcatcgtggcggccgttttatttctggtccttggggcctaggctttgtcctgatgctggtcctgtccctggtgacggttgactgctagtgttatcagcagatgagtcaaggatgggaacgcttagctggccatgaccttcaacaaggcaagcgcattgtacagactttacgtaccagagaggaatgcgaggggtctggcgaatgtgcaaaagggtgcaaggaagatcagcagcgagagcgagaatgagagaaagagacagcgagacggaaggacagacgaaggcgaggtgagcgaaggagaaggagggacagggtgagtcagtttgatttgagtttttgggttgcagcatgcgacccatgtgatctctgacgccatggcagggtgaaagacgataaaactgatcctgctgaatcgctatggcatgtggcaggctcgtgctaatacacacttgagcagtggaggactgccggcacacttacagcaaaaggcaccaaagaagagtcgagtgagtggaggagggaacacaatggctggaaggaggagcaagccgagtccagtgtgcgggacaaagttgggagagagactgttggaagctgctgaactggataggtgtcaggaatcggaaggcagaacagcgacaagagaccggttccaagaagagtcggagtgaccaggtgagggcgagaagtaggggagagtggaggggagtgtgaagaaggaagggacaagagacaaggacgaagacaaggcacgacagaggcacgacaggaaaaaaaggtgtgcaaaaagtgacgaccaaccttgttctggctgtcagcctcgagagcgtggccaagtgacctcttcccgccctgatccctgctgagatgcacccaaacgctcatctgcctcgagccccttttcttactcacagaaaagcacaacaacttttttttatattttccacaggcagcacgcacataaaagcggagctgctgaccgccacgagggccaccctcgcttctgagcatctaccaagacgagcggcatctttccacaatctggaacacccgacaacccctgactctgctgtccgcgtttgttattgctttctcgaagctgaaatccaaacctggcacaccctgactacttgtggacactccccacaagtcttctcgagctgcgctggagctcttttaggcaggccccatggggccagcgcgcaaaaaaaaaaaaaaaaaaaaactgtggcagcaggacagagtctcaaccctctttaactgaccaaccctttctaattgacggaaagtggcccgtgcctcctgactgcaaattttactcgacttttcagatgcgtggttggtttagtggtataattaccgcctgccacgcggtagacccgggttcgattcccggaccacgcaacatcttttgctcgcgacaacctttttggccgatgagttaacttttctgcgccgtttggaacgcgtttcctcttttttttttgctgaaggaaacggcgtcccgcaaccatgcgtagatgagcgatgatatgcatatctcttgcatgatcctttatctatccttcccacaaccaagcaatgatgatcctttatctatccttcccacaaccaagcaatgatggtcctttatctgtccttcccacaaccaagcaatgatgatcctttatctatccttcccacagcaaagcaatgggggcgcatgatccacactagccacgttgactcaagactttttgcaggggaaaaaacaatttgattttatttgctcaaatgtagtggaggctgaactagagatgaagagagagagttgatagtgtacaaggctatgttatcgtggtttctgtggacggtggtcaatctatatctctgttcagcgcccaccgtacttattgtcgcatgcgaattctgggtcgtaacatgagacgggcacaggaaccgcgtgcactacctgaccggacaaagccaaaaggaggatgacagcagcacagaggaaggttgcctgaggaaatctgaaggacagcatgattgttcggcgctggttgttgtttttttatatggttatgcgagaggacggggttcgatgttgggtatgcctggtgtggtcggttgaacgtatagcttatagttcacgactgctggtggagtgagcaaggcttgagtggactttcgagatagcactatagcctaagaggtctgaggcagcgagttgatgcaagcgtgagtaagaagtgaaggggaaacgagagaggagatgaaaagggcggacagggacctaaagaaaaaaaatcagacgcttatatacaaaaggaggggaggtactctcaatcggacaatagtcattgtatccacatccgctctgagaggcgactttagcccttcctttggtttctcccttgccccctccctttcctagctatagttcgttacttctttagttccgattctctccctcggctctgttccttgcacacctgttctctagtcaagactctttatcgctagagtaaagaaagccgacaagcacgagagtacctaaaaaaaaacgcgcgaaatgtgtgtgtatgtctggattggttgcgcaagcgagcagggttaccaaagggtgtgccaagtcgagagcaccagggagattatggggggcgcgacaggttcagaaagaatgcgagggcgcacaccaagcgggaaagaaagaaggagcactgctcagagcttcatagattcatcgatgactccttcgatgatttctcgtgcaccgcttgatagtactccaaaagaaaaaaaagactgatccaggacatgaacagagcggatctgtttcatgaagcaaaaagagcccccgagttcgcactgacgacaaaaaaaaatcaaaggactgacaacgaaagaaggagaatgccctaagggtctttatgagttgaatttgatgcgacgagaccgttgcaaatggccaatggcgcatttgtgtttccccttaaaatttttaccctttcaatgcttcattatgtcaacggttccttgaacgggcttgaggagcgaggctagaacaaaggggaaaagaaaaggcagtgtgagtaggcaggagagggatggaagacattcgagcgcctctcgcttgccgtgatcgtctctcggttagcgagaaattgacgctctttgaaagcggcgcattcaagcatctgaatctgcatcctcaaccagcgcagcctgcgagacgattacggcgagtggtggcaagcaccagtagccttgcgcttgccccttttctctctattcagcctgagcatatttttagaaggtcaagatcgcatacacagagtctagatacaatgttggtgctcatcagtgcgagagacggcgcttggggggcgttgatgtaagggtagaaggcttactcatgcatggctggactctccgtgttttctgaatctccccctgctcctttgaaaaatagggtacacgggccttttttcattttccggcctttatgcacgctgcgggagagcatagctcaatatcaaatcaaaaaaaaaaaatgcgcgtaaagctcaagttctcggccattccaattcgcaggaccatacctgctgttgaagattcatcttgtggttcatatatgttccctttttttattttctcaacgcttacgatggtaccagatgcgatgtcttaaacatcgaccttgcgttcaccgagaagacgctcgttctcatttgctaccaggcggttaatggcattgaggtaggctttggtcgcagcctggataatatccgagtcggcaccgtgaccgtggtacgtggcctggctgattccattggccttgctctcattgtcctttgcctcctctgcattttcatcactgtccgaggaaccgggtgacgacgtgtcctctgcaatcttgactgaaacctggcccaaagcatcgacaccctcacctacggccgtgatatcaaacttgagcaggcgaatactcttgcccaccaagcgctggatcgccaaaaagacggcctcgactggtccagacttgccaatggcagcatccaccaccacatcgccggtctggctgttctgcaactggaccgtggcggttgcaaacgatgtgcccgagaccacctggagcgacttgatcacgaacgtggccttgtccccggacgcggccgagacctgatccgacagcaaggcaagcaaatcctgctcggtcacacgcttcttgctatcggccaaggtcttgaaactgttgaacgccacctggaactcttcgtctgtcagctcaccaaaaccaagctcctggagacgagacttgaaagcagcacgtccagaatgcttgccaaggacaaggttgacagtgttggcacctactgtctcggggctgatgatctcatatgtggtcttattcttaagaacaccatcctgatgaataccagactcgtgcaggaatgcgttggcccctacaatggccttgttagattgtactgccattcccgagagcgatgacacgagctgtgagatcctgaagaacaggggcgtgttgatggtatggtagacagggaaaaagttggggtgggtgtggatggccatgacgacctcctccatggcagtatttcccgcacgctcgccgataccattgatggtgacctcaacctggcgaattccgttcatgatgcccgagagggtgttggcagtggcaagtccgaggtcgttgtggcagtgagcagaccagatgaccgtgtccgaacccttcgtattggcgatcaagtacttgatcattgacccatactcctccggcatgttgtagcctactgtgtcagggatgttgagagttgttgctccggcctcgattactgcagagaggaccttgcacaaaaagtcctggtcgctccttcctgcatcctcaggcgaaaactcgacgtcctggaccaaggtcttggcgaaggatactgcggccactgcgcgctttacgcattcgtcgcgcgaaattttgagtttgtgctcgaggtggatgtccgaggtagcgaggaaggtgtgaatgcgtttgtgaggggcctttgcgatggcatcgtagcatcgctggatatctgctggcacggcacgagcaagacccgcaattgtctatgcgagcgaacaagagagggttgtgtgagtgagtataggtacatccgtgcagtggataaaggcaatgcatgtcgcctggcggtggggggtatgcgcaacggcgcgattgccgtattactcatttgtatatcgagcttatgcattacagaagctgtctgaccaatcacagcgctgcaaaaaatcttatccatcagcgtgaaatccgagggttcatggccactgttggatacgaacttacaatgggcttgccaagggcttcacggccgaccatgagggggccaacctcagtcgcaatccgctcaacggcatcaaagtcaccctgggatgccacagggaaaccagcctcgaggacatcaactccgaggcgagagagctgcttagcgatttcaatcttttcgttcacggtaagggttactcctggggactacgagggcggtgagccgatgaggaggtttagagtataagtatctgccgtggatcttgcagtactagagcatgcattgatggatcggtgtctattgacagccatacctgctcgccatctctgagagtagtgtcgaaaatgatcaacttgtctttatttgcttgtgccatggttgtgtgtggtatatgccgtggtgttatgagggctgggaggagggagaggccggagggactgagagttcaaaagacgctgcaggtgcaggagtgtgggttagccaggtgctgtcgcagaggaagtgttgagggaaaagtgaagaggtgcgagacagaccgacgatcacggaatttattgaaatccgaggcgacacatatgagtaagacgactctacacgtgagaagagggcgcaccgtctttggcgtgctatctcaaggcacccaggcatcgagtcatttgcgtagtaggcgtagggcggaggccctcgctactcttcctgaaagtgcgtagttcacccctggaggcggaatctgctcgcagttgacagtgcttggcgctgaagggtgttgttgtggagtagtgcagcaacaacctcatctgacacaacgaggtacttggttccccgcacaagtcagacaaagatcaccgtgggtgcatgaccattgcaaaagtgctcatgccacatcatcagctccaccatggcctgcttgcatttcaaacaggcgccctcgctttgactgtgtgcagtatgaccagtcctggattccatgtcggtgaatcggaatgtagttccagggaaaagtctgcttcacagctgcacaccactttcattgactgcaactcgaccagtaaaccgtatcttgcctcatctcttcaactactcaaaatcaagcaaaggcgttacctctcaaagttttgtaaacttgaccttcatttgtctgccaagcacttgcacagtaagcaggcttgctgtcgctgatcctattcatgttcctcacttcttgatgggaaagcaacggcctcctttagccatagagatacttcactatcagcaaaggacattgctttgagatgattgtgttatcgcaggcgcgagttgacgcgatctctcgtcgagggggttgacgccgctgccattgaccgcctagaactaccaaaacgatgtgcagggcgactcgagtttgcatgctcgccttcttgtgagaaattgtacaggatgctcttgatgtgtttggagtatgatagttgcgcttactcgaagtagtcggctgtaggtggttcggcaagtgggtcgttcgacaggtgcccctcattctcaaaccctacagccgtaccttcagtgaacatacagcggacagtaaaggctttcagtgcctccgttccgcgcggcaaggaagcctgggaggctcattcacggtgttcatcgcacatagatcagagatgtagaggtgaaaatatacaatgtaatctaaagccatagtgaagatgagcggaaccgcacctccccagtacgtttgtattttggctagcatgcgactggctgcctcgtcccaaaccttcagataccataatcttggatggcagtggtgaacgaagcgttacagaaatgtttattatggtggtctatgatatatatacagtggtttacaggacaggtggatgatagcagttgacgcgagcgcctcgatggaatttctggattcgccatgatccattcaagggttcaaatcttatactcctcgtttgatgaccgtcagaccgcgtcgttccgtatgaataatgggcacaggcatcaagttgaacaagatcctttgacggatgacagccacagtgtcatactgcacactctccttgatgttagaaggtgatagtggatccagatcgctgtcgtttgccttcactgctccactgtcatattcctcgcccggcatagaggtcatggtgtcgtcgtcgtcgtcgtgcctgggaggagaaggtggtgggatcgacgagagtgatggtcgacggtatgactcgtccatatcggcatagtccttgctcttgccttttcctttgtatgagacagcatgatccgagtcgtgagctacgttgcctgctggtttctgttgcttctggatcaaaagcaaaggtttggccaacttcatcactttgccgtccagtctgtggttcccaataacgagctgtgccttgactccctagaaaaaacgaagcgaaaaaaaagcaggtgagttgcatggttcaaccgctgaagttcaaggacaggcacaagaatgaccgtggcgagttgctcatgcgtcttgagagaaggtcttactccatcgaggatcgacagctgtccgagagtgttgcccgcccacgactgcccatccatctcaatggcgccttgaaactccagtatcattatcgagttggtgtcaagacatgttgcaatggttgatgttggtgtccttcccgagacagttgctggtatcgatatgacgaccatcctctgtaatgaactcgacggtaagagggtcctgcgaggttgatgacaaggcgacaaaaaaaaagaaggttgcgcgaacgagtgtttgacagtcccagcgtccacttttttaaaagaaaagcccgaagtatggcttagaatctatgcagggcgaaatagggataaacaaccgttcgcgtccctcctctcctgaccagtatccaaccattcccccgaccaagaaaccgaataacgcgtcctaaatgaacacagagacccggacgctgcctttttgtctgcacgtcttgtatatgtcataatgtagagttcttttttgtggggggagggggggggggagagtgttatcaacagtttgtaacgcctctggctgtttcgatatcataaattgcgcgagtcgtggcaggtacgtcgacaatcttcagagatcatgagaagagaactgctggatcaatgctacctcatcagtctcagctactatattagcagtgtaggcgaaatcgttcaaaagcggccagcatactgctccctccaatccctgcctgaaccggctcgatcgcctcgctcctgtgtctatcgtcatatcgtccacactagccgcaattttgcacaattcgctacgcgcctgcgtgcgtgcgtgcgtgcgtgtccgtgtgagagcaaggccagtcctccgatcacatacgcacatgaaaaaaaaatcttaacggcaaaccttactgcacccgtgcaagtgcttatcgctaattcagctttgagtgcagtgaatctctttgtctttgcacttcgtatcacacctcagcgacccagactccacagctcctcccacgaccgacattatatcatcgacacagctaaaatgtctacctacgccccatccctccccaaaactcagaggagcatccagtggaccatccctggaaaaccctccgaagccctgtccctcaacgactctgcaccggttcccgccgtctctggctctgacgttcttgtcaaggtccatgccgccgcactcaatcccgttgactggaaactgatgcggggcgggatcgtcccccgtctgttgatgcccaaaatcaaagtaccaggcatggatatcgctggaacagtcgttggcgttggccccaaagccagcgaccgtttccatgtaggtgacaaggtcatggccatgctgagtttcgctcagtcgggagccctgacggaatacaccattgttgaggcatccttgttggtcaagactcccgagcgctggtcgtttgagcaagcggctgcttggcctctggtggccactacagtctggaaatcattggtagagtatggacatatcaagggcggcgacaaggtcctcattaacggtgccagtggaggaacaggtaagagggctagcagttttaacaatgctgaaacaagagtcgataggtttcctgtcaatactaacacttgaaaaaaaaaccatgcatgtctgctctcctaggcactgttggtgtacagatggccaaagcgttgggtgcatatgtggtcggcgtgtgctcaactgccaatgtacagctggtcaaggaccttggcgcagacgaggttgtcgattacaaaactacaagtgtcgttgagcaatacagaaaccaggactttgacattgtctttgacactgtcggctctgctgcagaggtaacattttcattactgttgtatgccattttccgtgtcattccgtatcccaatgcagcataaagccattcttgtctaacccgccttggtgctgtcctgtgtctagatctgggcaaacaacaaaacactcttgaaaccgacaggtaatttggtcaggatctcaggtccggacgacatcatggattcgcccctcacgttactgggtgcaggaatacacattggcagcaacaaactggtttcgttcttgcaaagagggcctggctatcatttgttcacggcccttgcagatggcaaggtcttggcccaggcagtcaagacgcttgatcaggtcgcccaggcagacccggtcatcgactctgtcaatgagtttaccttgccagctgtcttggccgcatttgacaagagtcagacaggaagagccaagggcaagatcgtgatcaagattgcttgagcgacccagctcaggcatctgttttcatttattcttttttctctattatgctgcttaataagactcctacgcgagacaaataccctcttgcaaaatcgacaggcatggtgttcaaatcctgccattagtaagggatcgtcgattttgagggtcgtgttcgttatgtttatttggtagaaaccgcaacttagtctctcaaacattctcagaaacagctttcagagcgctgacactacggctcttacaaactctgactgagaactgggtatcgggtgtgtatcgaacgatctcactccccggcggcgggttcttcatcgacgcttgctcggcctgagaacgtttctcgcgtattctccaaccgtattgccaacgccggcgtagttgcagatgtagatttcaaaaccgaaattgctgcagaacatcttggcgcagccaacggacttggtccctctccaaacaacctgagtgaaatggctagtgacgcccctagagagatcggggttgttgtaattgtagcccttctcctcgtcgtaccagccttgaacgacggcgccaaagttcttgaatatgcctggtgtaccccatgcaatgttttcgcccatctaacgatggatcaacccaaaaaagaaaagaaaagagcagagtgttggtcaaccggcattcacaagggcaaagtcatgagtggtctacaggcagttttgcacaatcagaatacatttctttgtctggcgtcgctgtgctggttgtatcttcggcagtgctgaatccatttgtggccatgattggcagctctgtcgttccagaccaaagggggagcatggtgcctggcacgaagcctgttgtgggcgttgagaatgagctgctgttccttcgtcaacctgggagaagccctaacggcccttgtgggtgtcgtcctctgctccctgagatgcgtgcgctcagcacgagcacgacgcaacaacgggcgtttgttgccaggggcagggaaaggaagtgtgtgcacacttgtctcttctttgggcaactgagcagcctcaatctgttcaagagcatcaacgggattgtagcgctcgatatcagcgaccaagttggagtgagactcggttgggacctgggcggaggctgagcaggcgaggatggcaacgctggccaaaagaagggtggtgagtttaaccatggtggagtctggtggtaattggtagtgtgtgggactaggatgctgagtgtgagggatagtcgttcagaatgcgagtttggcacagatttagttgctgtagaagcgtgaggtggtcgtgacaggaggtgctgatgagacgagtgagggttgacagagatcgaaccgatacgggggataacgaggtgttttatacctctgtctgcggtggcaccaatacttcggtaagcagttgggccgcaatgaaagcagggtactgaaggtgcacctttgaagctgacagaacagttcctacgaaacgacctctgagagcacaaagttgagacgttgggatcattttatgtgtctcaattatgatagcgtgcgttttgaaaggccgagaacaagagagcaggcgtagaaagaaggggacccataacagtactgtacatggacggtacattgaagagttgggcgctgtgaagagcacaacgcttagtcaaaaaagcaagctgcgagagactgcgaccttaaacttgtcatcgtcctcgcgcgaaatgtaagaatagttatagagataaaggcgtaactttggattaaaaactggagtctggtacaaggaagtcagggagcctataacggaaatactgaacacggtatgtgtattgccggtcgttgaagaattttgtgagcgagccgcttgtttttcagttattaggggaacgcgcgcgacaggtaccggatatcaagaagcagctaaacgagctgcagcgtatgcgaaattccaggaacggatctcagctttggggtgtttagtttagtgcagctgcaaggagccgctttgagaaaggtcaagatgtgcgacgtctgactgggcaagaccggtctcagcgaggctaggacgtccaagtcgagtttgaggagctgccgcaccttcggcaagctggcaacgtattacgctcctttcactcaccagatgagtgcatactgagaggatgggatatgcagtccaaagttttgaccagcggtcacctcaacacgttcgtccgctactccaagttgagcccgtgtttttcattaatggcaacatacttggctgcagccacggcgaagtcaggatatgcagcacgaaaactgaattctcgcttcatctcgaagtccagcggcgaaaggtagttctatagtcttttcgtagggtgatatgaccgtcatatgcggcaaaggccagcccgtacagctgtgcgatgttggtttatttgtagcaatacaaccgcaactcacatgagcgagaaaccttcactttctgcgacgcacgtttttcgcatattctccacccatgttgcctgctccggcgtagttgcagatgaagatttcataaccgaaattgctgcagaacaccttggcacaaccaacggacttggtccccctccaaacaacctgggtgaaatggccagtgacgcccctagagagatcggggttgctataattgtagtccttctcctcgtcgtaccaggcttgaacgacggcgccaaagttcttgaacatgcccttggtgccccatgcaaggttctctcccaactattgatcgattgacaaaaaaatgggagcgttgtcggtaaaccggaactcacgagggcaaagttctgattggtaacaggcaaacctgaaaagacaaagaaagtacatttttccccctgaggtcactgtgctggttgtatcttcggcagccctgaatccagtccctgccatgtttggcagctttgtcgttccagaccaaaggagcagcctggtgcctggcacggagcttgttgtgggcgttcagaatgagctgctgttccttggtcaacttgggagagggtttaacggccttggcggatatcttcgtctgcttcgtctgcttcttgggttgcttgcgctcagcgcgacgaaccagcgtgcgcttgttgttgggggcggggaaaggaaggatgtgaacggttccctcgtcttcggatacctgagcggcctcgatctgttcaagagcatcaacagggttgtagcgctcgacatcagcgatcgagttggagtgagactcggttgggacctgagccgaggctgagcaggcgaggatggcaacactggccagaagaagggtggtgagtttaaccatggtggagtctggtggtaattggtagcgtgtgggactaggatgctgagtgtgagggatagtcgttcagaatgcgagtttggcacagatttagttgctgtagaagcgtgaggtggtcgtgacaggaggtactgatgaggggagtgagacagagatcaaatagatgcgggggacgacgaggtgttttatacctctgtctgaagtgataccaatacttcggtaagcagttgggccgcaatgaaggcagggactgaaggtgcatattttgaagctgacaataattctcaccaaacgaccactgagagcacaaagttgagagccctgggatcatctatgtgtctcaattatagcgtgcgttttgaaaggccgagaacagcagagcaggagtagcgagaaggggacccgtagcagcattgtacatacctcaccctccttgcgaaaagttatggatagtcatagaggtaccggcacaactttgcgaaaagctgctgtccggcacaaagcagccaaggagcgacaaccaaagttctacacccagtctgtgtatctccagatctgctgttgcctttttttttttttttttttttttttttctttttttttgctgcttgtctcagggagggcggaacctccaggtgatcgacgagatcgccgcatagtttttattcatgaagcctgctcatttgaaccgaggcttggctggcccctggcggtcactaaggcttagcgagaatcaaatgcgcatgcagtcattgattgcgatccggtgcgaggtcttgaccttcggcgcccaatggaaggcacgctgagcccggtggaaatttcattaacatgataattacagcggggcacaggaatttgggcaaaggcgttcttctagacagacgttcatggacagggctcgtgatcttgtgcgacacgaggcaccgtgaaggcaaagatgatcctcagccctagcacttgcgttgttggcgacggatgccttcgatactgaggcagccatgtctcgactacgagttcatcggcaaagtgaacaagggccagatggcacagctgtgggatactgcgaccacagtcgccctagtcccatgagaagtcagtggcatcgcgatgaggtgttattttctagcacattgccttcacgaggaagagagacgtgagggcctacgcttaccagcctgcagtcgcagtctatgtccagtctatagttagactctaaaagtgacgaggaggaggagatctgctggagttcgagggttctatatgacatgccatgttccaaagtactcaaagtcaaagtttagaacaataacattttgcttcagctgcatataattgtagtttacttggtgcggatcaccttggcatccatcagtacctagttccttgccatatcctcgaacaaggacccgacttcaggtacatctgcgagagagaacttgacttagatcagcctctgtcccactgtgcatggcactaactgctcgtccacttcagatcccgcaatgttcccgtttccgcgacaaaagaacatgataatatggcttcatccgcctcaccatcagtcacccgcaggataaaatccacaggaccggtatctgcgtaaatccaactgccttcacgcttgttgacttgtcagtgctgcttggtatgaattcaaagcgccatgtggacctgaaaaattatccttaaagacactttctgatgggcagtctaagtagcgcttgtagagcgagattgtaccagctgacaatcgcctgtccacacatattaaatccagctgttgcccctctctttaaagagcttgttcgccgagcaatggatgtggatttctccggtcttttctagcttgcagacgacgcgtcatgtcgaaccctgacaaatctttgtgcgtgcgtatatgtaatcggagactcagatcgacatccgatcccgatcacacacacatacaaaaatttgatacggcaaccgaaccatgcttcacaatcgagctatgcagtcgatccgttcatctagttcaagccgacgacctacgcgttctggaatgcttataagagcgtcatttccccccgcagcagcaaccaaaagcaaagtttcttcctcaaccgagatatcctataaacgacatatatcaatggctacctacgcttcatcccttcccaaaacccagacgcgcatccaatggactaccgtcgggaatccctccgatatactgcacctcaacgactctgcaccagttccaaccgtctccggatccaaagttctgatcaaagttcatgccgtagccctcaatcccatcgacactaaactcatgcaagggttccctcctcgtttcttgatgcctgctatcaaagtccccggcctcgacatcgctggaacgatagtcggtgtgggccccaaagcgagcaatcgcttccaggtgggcgacaaagtcatggccatgctagaccttgcccagtctggaggtctaacggaatacaccgttgttgaggcatccctgctggtgaagaagcccgagcgctggtcgtttgaacaagcggctgcttggccactggtggcccacactgtttggcaggtgttggttgtgaacggaaagatcaagagcggcgacaaggtcctcattaacggtgccagtggaggaacaggtaagagggctaacagttttagcaatgctgaaacaagagtcgatcggtttcctgtcaatactaacacttgaaaaaaaacatgcatgtctgctctcctaggcactgttggtgtacagatggccaaagcgttgggtgcatatgtggtcggcgtgtgctcaactgccaatgtacagctggtcaaggaccttggcgcagacgaggttgtcgattacaagactaccaatgtcgtggagagatacagaagccaggattttgacatcgtctttgatactgttgatacagcggcagaggtatatcgccttccaccccttgcctctcactccttgcctctcaccccgtgccaactgcacgcagcctctttttttgccatatctgctccgcctctctaacactcagccattcccttacaatgtcctgatctagatttgggcaaacaagaagacacttttgaagccctcaggccatctgatctgcatcgcaggttctcctggggttgaaagattatccactttcttctctgacggagtagggatcggcaagaataagttgacctcgttactgacgagaggacccagctaccactttgtctttgtcagcgcagatggaaagagcctggccaatgcaatcaagacgctcgatcaagtcgcaaaagcaaaccccgtgattgattctgtcaacgagttcacgttgccgtctgtcaaagccgcgtacgagaagagtctgacaggacgagccaagggcaagatcgtgattagggtcgctcccatctcagcaactcattaatgagttgtaagagaagttttttttacttttccttcttctttactgatagtctaataaagctgttgcagcttcatttgaataaagagggagagaataaatacctatgcacttgatccacaaagtcgacgatagttggcgcatgacatgggaactcagagtcaacttgttcactgtgcttgaattgtgcacgtggagtgtctccgcgggggctctacctgacttcacttccatacggctttctcaccttgtctcttcgcctccgcgcggccaaagctggtacagaaggtcgccatatctgcttccggcccctccactctatgccgctgcatgacctcttcgatactgcgacgagactctttgctgtggagctttagccaaactcaccgattcggttgttcatttgaattatccctgaagtccttggttgaactactgcactgttgcctgagctgcgtctctcgcacgataccttcatgattacatgaatgcccacgttaaacgctttgaccatacagctttgtgcagtcgcctctgctatgtacgcgtcgcgtatgagaagtctctgagagggagagtcaagggcaagatcgtaaagatggtattttctttttactttccccatcgtcttttcttgctgggttcacaaatgccgtggctgcctactacttttccactacctcacagttccttctctgcgaaataaacaccctcctgcgcgcgccagatctgctcgcccttcgcattggtcggatgatgcgctgcaacctcctgttgacctgggatggggtttccatagacatgctgctttgaactgctcaggtacattccagtgttttggtgtcgcagctgaacgggcgcctctctgttccagaactcgtccttgtggttcaaacactccaccagccagttatcgccatcatcctgtccttcgtaggccgagacctcaagaccgcccgacatgggtgagtggtggtgatgagagtgcaaaaactttttggtgttggcgtgcttgaggcggatgctacttccacagggcactggctcacctcggtcgcaagtgtgtccgaactgggccatgactacccgatgcgacgataatgaaaaaacaaaggggcatgtttagacatacagtcttggcctatctcatgggcgatttgaagagcaagaagacggtggtgcgttggatatttaccgagccagagtgagttggtatcatccttgctgggaacggctgtcacggactgttgtccagagccggtgccgtaggggatttgatgtgagtggagcttgaactggctctgttcgtgcgtgagcttgacggacgatccgcaagtgaccttttggaactctatcaagattgaatcaatttgatggaaggcgggtgctggtgagattgcgacgcaatagttgctgattcgtagatagtgcgtccgtgtgtctggcgaggtgcatgcagctacgccttgggtatgcacaagaacccagctagtgatgagtaccatcgtcaatctctggtggtgggcctgccactgctgagctggtggcgagtgccaagcagacgagtgaggagagcaagaggcgcattgcgtgttgtccggacgtcccgaggtggaaggaagatgaagcaacgaaggcgagtgaggacgagagacaagatgagtgaatggatgaatgggatgctgctctggtcctatgtcacacaaacgacggacggtgtgttgtgtggcagtcaggcactggatcgaatgaaaagagtaccaattttaaagtttgctttacattgggctggagaggcgctcactcaccacccgtcattatcgctaaagatcttggacgtcttcttgctgggccggttgccagagtggcccatccgcttggggctgtgcagcttctcaatcagcttggacatccccggcttaaagtcaataaagtcctcccactcggcctcgttgatcttgatgtactccgtatccggcaacccaatctccttttcaaaggcttcttggcgctccttcctcgatatccgtggctgaccgcgatccggccccatcctgctatcctcctgctcatcgccaggaatggagtcatttgaagaagcaaatgggttcttggtaatgcgggtattgatcgtggggaacgttccatccacgagctcataattattgttcagatcagcatcgccttcctctccgttctcaatggctgcgcctcgctgcttcatgaatcccatcctttccaagaagctggtggacactgctggccgttcttctacgccgaatgcctcaatgtatctgtccgctgactccaagatctttctgcgatccgtgttcccgatcctaggcccaaccgttagatctacaaaacaaacgccaggattgttaaaaaactctatccataaaagagctttctgtacacccactttgaaaaagatctggatagacttactgtaacccaagaacgccgtgtaagcacttttggccagcttttcgtccacctttgagagcgccctcgtaaaccctcgatcgagactctctcctagcataacactctgccaatcgtcataatggtggtcttgcttcactgcatcacaaagcggcgacggcttgagttgatgctcgatgaagccttgatccagctcgccaagaatcaagacaccccttccatgatcgtactgctcgccctgttggcttttactgacattccggctcttgcccttcttgttgctgtcgcctcgtccagttcttcctatgcgatggatgtaatggtcgagcgacaggggcgcgccgacctgaatgaccagtcccactccaggatagtccacacctcgcgcagagacatcggacgtaaataaaacggccggggtcttgatctttctaaagttgcggctagtcaaggttcgttcccgctggtgcttcgcggaatgaatctcgaaaaccgagagctccttgcccatggatagtttggcaaacactttggcatacatctgcgcgcctcgtgtcgtcggcagaaagaccatgattttgttgttgtgtgcattaggtgcctccgctgctgcttttgaggatccagatccagtcacggtcgccctgctcttaattttggtttgcgcgcctgctggtacttttggtttcttcaatctctcctgctgctcaaaatccatgtcattaagtaaatggtccgtgatgagacggcggactagcgccacatgggcctgatatggagtgatgcagtatgattgacgagtcgccaagttgaggttgatctcgttggaccccacagtatcgatcatgataggtccttgagcgccctcggtctttggatggagtgcaacttcagacagtgaattcagcttggagtccatggttgctgagaacaagaacgtctgacgatcctttggcatgacttcaagaatggtgtccaacgcagagcgaaatccaagatccaagatcctgtccgcctcatccagcacaagctattccccaagatcatgaagaagaagtcagtgctcatcctgaatataactaacaagtaaaagtagagattgatgcctaccacttttgattccttgatcttggcagcaaactctgcatcgcgcaacaagtccagcatgcgtccaggcgtggccaccacaaactctgcgggttccttggaaatccgatccaactgtttctctcggctctctccaccgaccagatactgcacgccccatccgagtggtttgaccagcttttctgcttcatccgagatctgaagggcgagctcgcgggtgggtacaatgatcacacatccaatcttgcctcccatcttgatcctggcctccgcgggcgatagggccatgagtgattccagcgctgccacgatgaaggccaaagtctttccagttccggtcttggccttgacgagcaggtcacgctttgtgggtagggtggagagaacgctggcttgcaccttggacatggactcgtacccaaaggcagactgaatggcttccaaagttgtcgggtgcaagttcttgagatcattgaaggatcgagagtattccaatggcgtggtcggtgctgaggcaatggagggcgaccgtggggactttgctgtgtcattcagtctagccagtgtggcgctctgaatagccaggtgccgagtgcatattgatggtggcagcaaacgggctgtgtgtgctagagtgggtatctggcgtgcagtgggtagtacagcttttggcgtgtggagcagacggctgtattgacgttggtaaaggaggtgtggctgtatggacgcggtgcgtcgtagtgatcctgcctgtagtctacagacatgtggcagacgagccggcttcactacccgccattggagaagtatggacattggcctgatctgaacagtgcagtgtggtgcaagaggtgatcaaaatcggcactagagttggttctgttgattcatggaaacaagcgaattaggaaaaaaaaaaaaaaaaaagctgcgcgccactcggaaattttctggctgttcgttcagcccttcaggcacgatctcgcacggacatgtaagatcttttcagccatcgtcgaatacacactttgattgacccgcaacgtcccaagggacagcatgcttcagtcctgtcaagggtctgtggaacgaagccgctcaccgagaagggccgtgaagggtctttttctcctcttgcactctcgcttctaataaggtgcaagcaaaattgtgttcacgatggccacattcgtccccgatggattcaccctcatcctcgtccgttcggtgctgtggctcgcctggatcgaactctgcgttcaaatcctttacctggctatttattcgtaaaagtcgaccgaattcgagctatttcatacgcattttccggcttcacaagtaccagtctgcttcctgagccctatcttctcgcacatggtgccgtctgctaatgtctgaaatgtaggaagatgcccttccttgcggcacatcactacacactgctccttcatgacgaggttcttgtcagcaaatgtgcgctcgaccctttggcaggctgcttgtgcctcatccgaccagtcagcagagacgcggccagtttgcgtgaggccgaggatggcaatgacgacaaggagagcgacggtatgagatcggacgacagactggaccatgattgtttcttggtgattaaaatcttgacgggtgtgtgggcagacggcgacacaagaggcaaacttgaaggttggaaaagaggtacacttgaaggttagatcagcttgaaggttgaaaactaggtgaagcgttaacttgcctgaatcaggaatggtcagtcttttatacgtcgcaggatcgccccaggatcgagaaagaagggaagggtcaggacaaagacagaaaaggcaaggggacggaaagaacataatgcgggaagaacaagggcagggaaggataaagggggaggggggaaggaggcgaaaggccgatagtggtcgcacttaataccgcacctccgataattggcactgggcctgcttgagcatgcaatggcccgatgctattgtccagtggatgttagcaccaatggattgatgaattggagctgagacgcaacgactagaggacagtggctgaatgcaagcaatactccagattcagcaccaaactgcggtcgtcttaagcacagcaaagaagaccgggcgacagttaaaacgcagttacggtcctaatggtggctgctaatgtctagagcctacggtcatgattccttattctctagcccacccttgtactaacgcatgtccctactctcatgagtttgctggcgaccgcaactcgtgtttcgttacttttcccttctactgatggacagtcaaacagacagctggtcaccttttgttacgaaaagccgatgattttataagagtaaaaaagatgggttgaataataaaaagaggaaataatggtcactccttcagcggatctattgcgtctttgcggctgcgcggacagggtcaaaataggggtgctccatggcctctgctgcggtcagacgctcctggtgatcatagcgaagaagcttgtccagaaagtcgatagcggcgttcgacacaaagcgctggttttctggcgtcacaaatttgctccatggcttgcggggatatcttccaagaatctcgtcatactgcacgtccagctccagatcatacttttccaagtacgcaaacagttcgttggtgccgagaacgcgagcgatcttgacgagctgatcgtaattgtcgtgtccatggaaaaagggctctttgcggaagatctaaggaaggtgataaccgttcatgagtgtccgttcgtggaatgatgccgttgaacagtacaatcacatacggaaacctgttgcctttcttaccatactggcgaacatggcgcccaagctccacatgtcaagcgagtagtcatattcctggaaatcaacaagcagctcaggacccttgaagtaacgcgatgccacgcgaacattgtactctgtgccggggtggtagaactctgcgagaccccagtcaatcaagcgaagctatttgtcaaaattagagaggcaaataatcagtttcgagccaacaatatgtgctgtctgtgcacccaagttggcatattgtgtttccaggcatgatccttgacgcaccttgcgcttttcgtgttcgatcatgacattgtggggcttgacatcgcgatgcatgataccctttgagtggcagaaatccaaggcctaagcgatatgatggtgcatatactggtcaacaaaccgcacatcataaaagctgtgaaacgctgcagcattaatccttcgcctattcgtccccccagtatggtaccttcagcaactcaaagatgtaaaagcgcacgtcaaaatccgtgaatttggggtaaaggatcttgaaatccgtgttgttgacacactcaaagatgagcgatggcgtctttgactattttcgtacagaaagtggaaagtggtgtcagtatgctccaagtcatgttcataatgtcgtgcccaagtggcatacagtctatccactctgagctcgtcctgtccgcattcatgaggcagatccagtcgaagtatgcactctctgacgatgcatcggcaagcgatactaagcggcatgatgcaggaggcggactcgcactgctcgtatcacaagccacatgccacacgctgcccttcttacctgaggatcgcggaccacatcaaagagcgtgatcacgttggggccaccagccaggttctgaagaatcttgatctcacgcttgatcttctttttcttgacaggcttaagaaccttgatgcagcacttttcgttgttgacagtgttgaagccctcaaaaacctccgagtatttgccacgtccaaccttgcgcacaatctcgtagttgtcctggacactatatcattttaagaagatagtaaacaacgttttctttgataagtacacagtgtcatccacagggaacatagaatatcgagaggaaacacaagggagggatcatgtctgtggtcctgacaagagtcatagcctccaagtagctgatagtaacagacgagcacgagagactgcagacgtatcatgaagaggaaaggaaaaaggactgtgcctttttccactctctgactcaatcgggtgccaacagattgagggcgagattgatgccgctgttgaatctcgagtcggctgcaactgacgtccgcagagtaaacaccgcattggtcatcgcgaagataagcggtggcgaagagattttttcccccttcctgtcaaaataaaaaaaaacgatgacagagccgcacaaggcctttgcttggcaaccaatgtccaagcgtttgcccctcatgcgacgacaagggagtgcgaggcagtgtattgctgaaccgatgctgacggccttacccccactgaacttgaaggttgtcgtagtcccagtactccttttggagcgtctcgttgacgttcgcatacacacgtgcgacgcttccagttggcattgtgaagtccctgcgaggtatgtcccagtccggagcaggattaggtcagagagtggaagcaacgaaggctatcgtctgagaatgagacggagaagggaggggtggagaatgcaaggcgggagagagcaaacgaaaagcaaaacacacacacacacactgtgaggtttgtgaaaactgaaaaacaacaaaagtatcgtttatatcatgtgattgtactctacagttcagcaatttctgctttcatgtcgccgtttttttgcgcctccaagtcgtgcagcggttgcgggttcggcttggactcgtctacaaaatcgtcattgggatggatcccggtcacttgctccaggtgcgagctactctgcgctcgtccttgagagtcttctgccaggtgactaaagtcgcgaggaggatgggggacatggcagcgcttggctgtcagcgagggataatactggtggtaggcgaacgtggcaaagacaatgccgaggatcgagccccaggtgacatcaatgccagcatggcgcgaatcctgcacgcgtgtgatcgcaaccagtagagcccctacagaacgaatggagcaacgttaggagtgcactggctatattgcagaggttaaggtgcgagtgctttggaagcaatgacttaccgaagatggggatgatcaggatgacgcccttgagggaataacccctgcggtcaaagacatgcatctttccagcgagccataaggacaaatagaacaatcctgcaaatgcagctgaaaaagagagtcaagggagtgttattcttagcaccctgggcacaatgagaattgaaagcgcacggttgtcgacctactggaagcgtgtccggacggaaaagcgcgcatgccgtcctttaagattttcttgtctgtctgagtgcacacgtcgattgtccagaggtgcagcggccggtcctgggtgagactcacgccattgagcataggctgacagcgactgagaaaatccggtctgtgttttccgagcgttagctaagaaaattaaaagattgaggtcacacgaggtcaaaatgcgtacaaatatttcatcatcatttgtgttcctttggatcctttggccagaaaggtacggttgagcgggttactcgcgacgtccgacctcctcctctccccttccatcgctgaggaagaaaacttgaggctgttgcctctccttactaaactggagacgactcaaacattgaggaggcgatctgttctcggtgtggtcctgttttaggcacctccttgttggcccttcgcaaaactgccccagaggaagccgcaaggatgcgcagccactctctggtgaatgccatcagcaattaccttgataacctgggtgaacatggtcgtcagaaggagggacaccaacagacctaaaatgccgttatggacatcgtaggggcttcttcggattccaaggccaaccaatgcgatcacgaccgctgggagtacaaatgcgatgaggacgagtgaccatgtagggattttgtcctccttgtattggtacatgatggcagtgttctcgactgaaaactcgcgatggataggttcgaatttgtccagcaagaagaacaggaccaggaggacaaggcacagtgcccaatcaaagaggtacgagcatacgagtcggaccgaggggttcctcaacctaggaacgagctgcatgacagtgctatgatgtcgatgatcggtgagatgattcctaatactgcggggagggtgggtgggagtgcggatggcgatggggaaacaaggaaagagaggtggggagtgtgatttgcgaggcgagtgaagagagcagagcaaaaagaagagggagcagcgcaagccaacacaaaggagttgcaaacttaaatgcacgacaacagttcaaacgcagtggttacgcgctttgccttttctcttgttttggttggtgttttcgtgctgggtcccagtgcgttcgtgcatgacggacggtacgacgcgggcccggcagccacgctccatccccattgatactgaagattgtgtcctgagtgcactgtggacgggtatttgggatcgcagggatcctccacggtgcgaccagttgcacgcaccaggtgagcataagccaccagacgggtctgcgtttgatttttttttttcccccttcttttcgctcttcttcgcttcttttgtctcgcaacgagatataaaagtgaagtgtgttgtctgcccgtggaaaaaaaaagagtaccccctcacccgcccactcccactgctgcccccctcctgctttcctacacacccacctcgactattgcactcacacacactcacagacactcacctccctgcttgcgccaccaaaccctcgtctctcccattcgcctcccccactctcgtcgtcccccctagccagcgccctttcccatccgtgtcagatccacccaccccacggtaggcacatctcgccaggaccaccccctgccatccccatccgcacaccctcgttgcctcccacatccccccagcacgctcgtctcttggacccctagaccgtggcctcgcccattctagggcactgcgccatataaccagacctgcattcgcctagatcagccagatcacacagatccacccacactcggttctgggccccagcaaggcccatgccactacgctagcatgcctgctgcctctttgctcgatgccccttgctccttgccctctaccctacggcgatatctgtatcacggcgcacctgcgcgtccttgcttcctcgtacaccgttgaatcctttttagcatatcgatcgcgacgcgtctgtgtttcgtgaccctcacctagagactgcacgcggaccgtcgatccctcttgcacaacataaatgctaattcagtccctcccactctaggacggcacaaggacgagattggcgtgccagcggagtatatcactcgaagacaaccagtagatagcagacatggctaccaggtacttgctggcgttctcctcgttctatccaagtgtactactgtcagctgcatccaagaggtcaatattcacacgttgatcatttttgcttccatcttcattcttaactcggtaggctcgaccgtctagtgcttctcctcgagacaggatcgacagctgcagtgcgagctacggccgcacagcagctaggagatatccaaaagcagcatccctccgagttattcaacttactgtcaagagtaaagtcgcttgttggcctcactctttgaacggaatggtttttggtcccgatggtgactttgactaactatttaatgaatcgcacataccttctaggtgttagtgcacttgcgcagcaagaactgggacaccaggattgcagctggacaggctttggaagctattgttgggaacgtacctcagtgggatccgtcagatggtatgttcgcgctcccacagacagctccttccttcctatcgcctctcgctctggcaagtttactcagtcgcttgactccttacatccgtcatcggatcatccaatagagcctcaagtaaaatctgacgatggatcagaaccctcgaaaccaacggaacaatccaaatacgaccgactcgccttctcaaatttcgacattagtcaagtgctccagaacggcaaactgcttttgggatcggcaggaaaagagtatgatcttgacctgagcgacctggaccctgcagagcgcctggcgatccagcgaaagaatctcgccaccaatctaggcttgatgacatctcagttcatggatggtaagctaatcagcttgttccattgaacaagtgcatggggcaaaacgcatcaagagtacggactgactgttccatgttgccacttagtcgacctcgttgatgagtctgatatctcgggaccaaaagcgccgtcattacccataaagtccgagcaaccagctgcatcagccagtacaaccgtcgcctcagccgcatcttccaaagcaccgctcctgtcacctgcactcccgaatgacgcaaacatggaaggattaagcgcgcgagagagaaataagctgaaacgccgagcaaagactgatttgaaattcaagggcaaagacaagtaagtaccggaaagatgaaggcagtgagggcataatgaattatgagaataagatcaaaatttgacattgttgatggcatcacaggattcgtgtcattgatctcgcaggaaggcgcaagggaccggaaaccccaggaaccccaagcacgccagcagcagctgcggaaggacaggacgggtatttcgagtttacgccccagtcggattccaataaggtggtagtagaggccaaattacccgttcagtccgtcttggagacatctacagagtggccctttgagggcatttgcgatttgctttgtatggacctctttgatccatgctgggaaatccgccatggagcaggaatcggactccgggatattctgaaagtccagggtagcggtgcaggccggatcgttggatgcacaaaggcagaaaacgacattcgtcataacgaatggcttgaagaccttgccattcgccttctctgtgtcttttcgttagatcggttcggagactttgtttctgatcaggtaacacgctgcaacgtgcttgtgctgaaggagccgcgtgtttacttatttgcatatcatactaaccttgctgttcttattgcgtaggtcgtggcacctgtgagagagacctgctctcaaacccttggtgcactcctccggcacatgtcagacgagggcgtcaagagtactctgggagttctgatgcgtatcatctatcagaccgacgtattcgaggacgacgtagaacgggattatatttgggaagtgcgccacgctggtcttctcggattgaagtatgcggtagctgtgcgtcgtgatcttctcgacaacgactccccctatgcactggaaatgcttgagaacgtcgtcaaggctgtcgtgctcggattacaagacgaagatgacgatgtccgagcagtgtcggcatccacgctcatccccatctcatccaactttgtcaacaagctgccggagcgtatccctgacgtggtcaccgttctctgggactgccttgcagtattgaaggacgacctgacggcttcgacagcaagtgtcatggacctcttggcgaaactattcacataccaaagtgtccttgattttatggtccatcccaaagatgaaaggtaaggtgctttgctcgtcctttttacaaagtattttgggatcaattatactaagactgatattatctacttcatgtcctagtcatgcattggtgcatctcatccctcggctcaatccctttttccggcatacaatccccagtgtccggatggcagtcttgaacgcccttttaaccttcttaaagttgaagtccatcgcagagtgggtcgatgaaagagtggtccggatggtgtatcagaacttgattgtggaggagaaaaaggagattctggagctctcactgacggtgatggcagccttgatcgaacatatggttggtagcgaatcctcaccgctgcagactgtggttggcccacacctccagacgttcttcaccatcctgctcactcctgtcggtaccccgctcgacactcgtttgttctactcgccaacaggacatggatcggcaccggtcattgtggatacccaaactgcgcggggtcgtagagcgcaggccgcacagagtcactcgcacaacgtggatgtcggtatgctgaagcaggacttgagtctcgtctcgatcaccgcagtcgttcgttgccgtctgacagcaagtaaggcattgggactttttatggccaactggccacaggaacaactagacagtacattcactggcctgctgcaacccaatttcagctcgtcttgggccatgcgtcgtcaaatgacggctatcatcgttgccgagtgggccacagcgttcagagaccggacaggaacctatcctacggaggcaggcgttccgtttggcatggccgcctcaacagctctgaccgagtgtctgatcgcggatccaccttccagctatcttgaaagtatcacggtcctcaagggcattcgaggagagattcaagcaatgctgaacgcgtttgtcgctgacgccaagctgccccaggcgagcattccagtgcttccaccgcttgctggtgcgggcgagagcgcggtaggaaccggtttcacgattgactatgcgcgcttgtttgcagcggagacgtttcccagtcttctcaatcagatcagcgcacggacccgcaaggttgcagtccccttgatgacgagtcgacaggagcgtgtgattgcaagtatcggctattttgaatcactcaaggagaaggctgatctctacgtggccgccgctgtcggatccgctgtcattaatttgggaacgctgcccgcgaagttgaaccctgttattaacagcgttatgaagagtgtcagggtaagtgtgaacgacggtgtgtcatatatgtaaacaactgctatgtcgttgcacagcagtctttcgctaatcgattacgatgcctaaattgtttagggcgaagagaatgccgaactacaagtgcgctccgcagcgactctcgctagtcttgttacgctctgcaactcgccctattgtcagctgcgtgtgaagccaacgccaaagctcatcaaaaaccttgggcgatacctctgcggggacacgtcaattacgccatccttggaccaagattcgtcattggagggcatattttcgttgaaaaaatccaaggaagcggcggcagaggccaaggcagttggcggtcatggcatggacgatgtgaagatttcagccaaggatgtcaagcctgtggaggatgaggaggcgaagctgacgcgacgcggcgctctcgccgcatacaaggagtttgcggagcggttcgggtccagtctctttactgtggtgccaaaaatttgggagtgcatccacgatcctcttatgaccgcctttgccaatggaccgatcacagaaccaacgcgtttgcagcctgatgactggcacgatatcattgacgccctggaattgatcaaaacggtcgtaccacacctgcatacggaactctacccctccatcgaacagttgatgccccacatcgctacggcgctcctgtcgcccttcacggttgtccgtcatgcagcagctaaatgcttagcagtcatctgcaatgtgatcactgtacccggcatgcatctggttatcggtcgtgtggtgccccacctcagtgatactgccaacgtgacgcggagacaaggagccgccgagatgatcaatgaggtcgtgcagatcatggacgccaagatcttgccgtacgttgtcttcctcatcgtccccatccttggtcgtatgagcgatgccgacgagcccacgcgactggtctcgaccaactgctttgctcacttgatcaagctggtgcctctggaggctggtatccccgacccacccgagatgtcggccgagatgctgcaacagcgccaggaggagcgtcagttcttgatgcagcttctggatagcaagaaattgcagccctatacgattccgatcaagatcaaagccgagcttcgaaagtaccagcaggaaggagtgaactggcttgcgttcttgaacaagtaccaactgcatggcatcctctgcgatgacatgggtctcggaaagacactgcaatccatctgtatgttggccagtgaccaacatgatcgacagaacaagtttgcggagacaggataccctcaatatgcacactgcccctccttggtagtctgccccccaacactaacgggacattggtttcacgagattcagcagtacacggacaatctcaagccgatgatgtacacgggtggccctgcagagaggaaacggttgcgatccatgatacccaagcacgatgttgtgatcatgtcgtatgatgtggtgcgcaacgacattgaggatctggaaaaggttttctggaattattgtattttggacgagggacatatcatcaagaatggccggacaaagatcacaaagtcggtcaaaatggtccgtgccaaccaccgcgtcattctgtcgggaacgcctatccagaacaatgtcctcgagctatggtccttgttcgactttcttatgcctggtttcttgggcaccgagaagcagtttaatgaaaggttcggaaaaccgattcttgcgagccgagactgcaagagttcatctcgggaacaggaagcaggtatgtcaacctttggttttaaaattgtaaccatgtactgatgcatgacgctctatgtgaagaacggctctgactgaggacctggaaaaaataatttgttgataggtgtacttgcattggaggctcttcacaaacaagtcctgccgtttttgatgcgccgtctgaaggaggatgttctcagtgaccttccacccaagattattcaggattactactgcgagctcagtgacctgcagaagcaactatacgaggagttctcgaaatcgcagatcaagaatgaggtggaggaggagctcaccgaagataccaaggtcgcggacagtccacagaaggcgacgcatatcttccaggcactgcagtacctccgtaagctgtgtaaccatccacttctggtcgtaaacgagaaacatcccgagtacaataaggtgatgaagcagctcaagagtcagaaccagtccattcacgacattggatttgcgcccaagctccaggcattgaggcagctgctgattgactgcggcattggatctaagcctgtttcggaatccagcgcggatgtcgaggcctcgctcatctctgggggtgggtctgcggtcagtcagcatcgagcgctgatcttttgccaacaaaaggccatgctcgacattatcgagaatgacttgttgcggccactgttgccctctgtctcgtatatgcgtctggatggtgcagtggacgcgtcgaggcgacacgggattgtgcaaaagttcaatgcggatccatcgatcgacttgttgttgttgacgacacacgtcggaggactgggactgaatctgacaggagcagacacagtgatctttgtggaacatgactggaacccgatgaaggatctgcaggccatggaccgtgcgcatagattgggccagaagaaggttgtcaatgtctatcgactgatctcgaagggcacactcgaggagaagatcatggggtaagactgccgcgtttgttgttgctatcgcatggacgagtcatctctagagtttttgatattaatgcatatttcttcttttcgaataccacgcgtccccctctagtctgcaaaagttcaagctgaacattgccaacacgatcatcaaccagcaaaactcgggcatccagagcatgggcacggaccagattctcgatctcttccagatcagtggcgaggatgagtccgataccaagaagaggaagaagggcaagggagtttcggacagtggagcgaatggaggcgagggcggcagtggtgtggatcaaaagatgtcgaccaagaacgtgctcgagtccctggagaatctctgggacgagaagcagtacgaggaggagtacaacttggactcattcatcgcgggcctcaaatagtgaggatttttcttttgcttttttttatttgctttagacttttttccatcaaatttctcaacaataatcaaactctgtgagcagcaaagcacatgcagtcataagctggggcggcgaagcacgccacggtcgaatcacgaccaagaaaactccgatccaaccccactgtgttttttcaagttgctgtcgcatcagttcgctggcataggaggcttttggccattccagccagatcgccttccacttttttgttcggcaaccagtccacaccttgaatttgccgttgcctattccaggcgtagcctatgatcgctgcccttatcattggtgaatgagtgctggacatggttaagaccgtgcaagttcgttaggatgctgtgcactgctcgcccgtattcggctcatgtctcctattgctgttggtggagccatcgcttatacttgttagatctatgaaaaaactacgacgactgaatgaatcagctcaaggttgattgagtacgtgatctgaagctcgtccttgtcttcttccatcgtgatgctggggcggatctgataaaccttgaccgaccagcttgcatctgtgtgcttggatgcgatggcggtcgtgtggtagaggttacatcttctctaaggatgtccataaggagtctgtgctttggatccaaggtgttttcaaccatgaacgtggagagcttgcacgaaccagggtctataccctctatgctgccaacgatgcggctttcttcatcacccagcgccctaccatacctcatgaggctctcgatcgtctcacatagtctatatatatggtgcctttctgcggttggcccgagctgatggcgaggttgcagatgacctggacgatgagaacgatagcttcggagctggctgatctttcttgggatggtcaagattttcgcatagacttttactgggtagccgtccgtggataatgtgccataaagaagatactttcgagcgcgtcgcgcttggccagcatactgtacggtggtcaaggataccctatatctcgcagcacgcgctagagagagaggctggcacagtcggcgcccttcctctctcccataacgcgtgagtccttcatctatctagactatctattctacattacctatagtattcacaatataccatgtataagcgtggtcggtgtggtaccctcatctttttctcacttgctgcctgctgaaaccggcccacgatgtttgcagtgcgcagaaccctgtagaagggtatcctgatcgtaccggagtatattctaacagcggtagcatccaccgagtcgactaaagtcatatcgccggccctatcgcactgacagcgctatcacagatatatcgtagactacattcgcttttatgagttctgggacaaagaccaagcccagacagagcacacacgagctccatatgagggaccgacattttttcgccacgttcggaggacaaattgataaaaagaacattgatcagatttcacgcccgtgcagagcttatctgtccgctggcatatgaagctcaggctgtctccagccaatcgcgttccagttcccgctttcgccatactctcattactcactgcagagacccctatcacatatcttgtgtatcctttttttttttactggtgctccttgtacctctccctttgcttctcttttctactcgctactccctactccaccactcttcgttttcttatcgtgcagtagctgtctgatagccctctgcagcaagcttgccctccagccagacatctcacggacaacaaggattccatcaagaacaactccattcaccatgcgccactctgtcatgaccgagcagccgtcgcccatgatgtccgcagaccagttcgcactgcggcaccatcacgcgcagcagcctgccaccactgccgctgtcgccgctgctgctgccgcatccttgacctcgggactcctccatgcatcgctcgtcgctgcgtcaagtagtcaaagcagcgggcgcacacccggcacctgcagtagtatcagtagcaacagcaacagcaacagcaccactggatgcgagtataatgtgaacaacagttacagcgcgacacaacagccagtcaagaagcctcgcatgccccactgcgtagccgcacccaccatgtcctatacaacactggcatcactagagtattcggtgcacgtctcgcccaagagaatgaccaaagagttgactacagtgttccccaacagagatctgtccaacctgctggtagtgccgacagtccaaaagtgcaacaacgatatggtcgcgtgggatgacgagatcgcaaaggaaaaggacgaccgcctggaggacgtaagtttttgtttttgcttggctagaactcgctcttgtacttgagatttccagctcgcaccgaccctcatcggaacagggatggcgagatggatcatctttgctttgctgatctcgacaactgcagcagggagccctgatacagatgcccatcaatttccaagggacagagagagttcgagattttgacaactatcatatgcgagcaaggagatggcattgcgacggcgctcgtgtctatctggacattggatgacacccgattttggactaaacatggatgctctcagatggcagctgactgacatgcatttcttggtttatcttcatgttgttagtttgtccgctgggcgactgcactgcacgatcggcttgagatactgggattctggtccgacatgactgaccccgcctctgggtttcccgtgagtgtcttttttgttttggttgaactatgcgctggatattgtgaaatatgtgattcttatctgttgtcgcatcgagaacctaacatcttcattgttgaaccacacgataacgccaatgtgtgtctagtcattcagcgaacgcgggagagatgtctatccagatgtggaaggctgtcaattgctgctcaaatacgactttcagaacgcgggctgctgtaaggtcctgttgcatcccacctggggaagcaagatctacccggccacattctttacgactgcgcccacggacgtcttgctgagagcagtggaggacattgagcaagagttcagtctgcaagcctaaggggctgtatattttcgcaaggcgcagtgtgcctagagttgcaaccaaccaccatacctgtagagggtcccttcttgtgtcccgtctctcattgatcccactttgtattcctatccatttgtattatttttttttgcaccattcaaatacacgcgctcctcagagcacaaagacccgagtgaaatcgggattttttcacattttgttcaaatgcaggcatttttgtatccagttgggcgttcctttttttttttttttttttttttggttcattcaacacctcatctgccctgaacactcattcttgccatggacaacgaatcgcggaccaggagtgacgacaggctgttcacgatgcaccgaggcatcttgcttctcgtgccagcggttgttgccctgatcgcctcatcctcatccacatccctcgtccatgcctcaccctcagccatgcacgccagagccctccaggcctcctctcagtctgacctggagatgatcacctcctgggagccttcagagccgtctcggttcaacccgcacacaggatcgctcctcgcgccgttcatgatccccagagtctcgggcaccgccaacaacacgcgtgtgcaagaatatatcctagattttttcgcaaagctcaacacgacgagtctcgcaggcgaggatatgcacaaccaacccattactgcaggcggtgacaagggcacaacaaagaacaatcagaggaagaagagatccgtacaggaacgagagaagctttttcgacgggcaccaggaacgccagggacggggtggcatctcgagaaggacacgtttgtgggtcagacaccgtatgggcccaagacgtttacgaacttgatcttcaccaagaaccccaaggcagagaaccgactggtgctggcggcccattttgattcaaaatatttcccgcccaaggacaccaagccggcgtcggaatggaatggaggagaggatacggaaccgtttgtggctgcgacagattcggcggcgccgtgtgcgatcttgttggatgtggcggcgagtctggatcgggctttggatcagcctgggaggacggataaggacacaacgttgcagattgtgttttttgatggcgaggaagcctttgtggattggaccgcgaccgattcggtttatggatccaggtaggaaaggcgagagagagacagagagagagagagcgcgcgcgctaggagcttgttgttctgagcggtctagaaagcaaccctccaatttcttttgcttccaacctacccactcactcacccatttcgattttttatttcccctttagacatctcgccgaaaagtgggcaaagcagaccgttccccgttccaggacggcgacgggcaggaatgggggctcgacagccaataacctggaagggattgaaatgatggtcctgttggacctgttgggtgccgagaagcccaccattccttcttactttagcaccacgcagtgggctcatcggcacaccatgtcgatcgagcagcgactctgggacgccaaactgcacggagcccagatcttgtccaagaaaagagccaagggggatggcagtgatagcgatgcggaggcgggaggacttgagggtgaggaacaaaccgaggatgaaatggatcaattggaaccagaggaacctgtgcaagggttcctgtcgtccgcggcgccttggggaggcattgatgatgatcatcgcccgtttttggaacggggtgttcccatctttcatgtcatcccatctccgttcccgaccgtctggcacacactttcggtaagagatgcatgcagactgcacgccgcacttttatctagcctttatgcatgtttacttgcgacctcatgtatattcatgaaaagacgatgtaactcatcacaaaactatcgatatcatctctgtaattataggataacgcggatgttatttctgaggaggtagtggaaggctgggctaacatcttccgtacctttacggtggagtaccttcaccttttgaggacaagggagcacactcgggatgagctgtaaagttgcaccgtacttcatcatatagtcctggtgtgttgggtgcatggatgccaataaagatagaccaacgataaaagcagctgaatttatatatcatgaatcattgtcctattcctagtctgacatgagcgctgcaaacatggacacttgcaccaacggtcctgtcttgctgagtgtgatccctggcgatgactctagtgatgagattttggacagcggtggagaagatccattcctggatgacaaggatttctctctaaatagattcgcatcgtgataaggttggtcgtcgtcgtcgtcatccgtatcctctcgttcacttttcttttccgaccgtgctggcggaatggcggcacccaccgccaccacgagcgctggacttctgcagagttgtaacttgattccggggtgttttgctgtccaagactttgcacgagttaccgaggccgtaagtggcataagcgaattgacatctggcgtttgccttgttgttttgatcgctctgaccgttagtcaaaacgtccagtatcgctctgagaactaccaacaagaccactttgccagtcaagtgcggtcatcacagatgaagtgcctttcccgcacacccgccgctgatacctttgttcggacttggttccatgtctgtatggatttttggagcaccctgaacatgtcggatcgatggtgcacatacatcccatccatcccgcgagaaaactcggggaaagatccggctgagaacagcaccaggtaaagaaaactgttaacgttgaaggatgatggtatcaggagtgcgcacacaaaaccaagcaagaaaattgccaatacagatcagagtcgacttctctgcccccttattgaaactaacatggacgagcagatgcgcgactacatgattgaagcaacacatttattgaacgggtgaagatggaggtccaacgtgtatgcctaacacctccttcgagttgagatccaactttactcccactggtcgtgttgcgctggcacaaccttctcacattttaggcctcaatgcacgcgcgcagcaacgcttccggtctaacacacatcgcctgaccgacgagatgtccggccaccctgcaatatccctcctgagtcaggcaatctctggcaagcagagcgtacaaggcggcactctcctcggcactcgcatacgcattcggtcctgaccacgaacaatggtcaccgaaccatagtctccgtagctcgtcctggttgtcgctgagcctcaccacttcgtaccagatggaatccgtgtccaagttaaagtcacgagcgatctcgcggcacatgttctcagccaaggccttgaagggcttgtccttgctctcacacgcctgcggatatgtctcctgtacaacccgccatccgttgtagcgtctgcatattccgctatgggtgatcatgaaccataacgctaccaagtatacgtcgcttgcctcacaaacctcactgcagcacgcgactacggtggtgaacatgctcagcaacacatcgctcgcatcctccccgtacctcgacagagcaacccaaactacgttctgctgctcacagttgaccatatcccgaccataatccactgcgtcatgccatattcctgctgcccatgctatccataatgcggcgcgctgagttggtgcccagtcaaatatatcctgacggtgcagcaggacaccagtgtcaaagccgcgattgaggcatgcaatcatgtagtcacaatctgcccagctcgacctgtgggtgacagaaacctcaatcccgcgtacggcaatgctgtgcctcagttcttgaaagagtatatagtcatgcgtctgtgcagacacatcagcgccaccagccctccactgatagtgaaaggaaatccagtcgcccactagaccgcctactcccttccatgcctgcgcaaacgccggctggcaatcaagcaacgcaggtagtaaagtacctataccgcagccgagggagcgccatagatcggcactatgcgcatgcatgagcaatgctgccaacacgttgacctcccaaactgtggtgctaaaatgatcgtccgcgaagccgcacatgtgctgcagttccaccacagaatcgtcgcgcttgccgagattggcatttttcacgatcacttgtaccggtccatcatagccggcgatagctcctgcaaccggtggcaccgtgtcgccgtgcagtatcactccgagcattgtcgagaacaattctttgtcaaggtactgtggtgggctctcaaccagaatcctcctcaatgcactgtcatccggcaagcctatcgcgacggcgttcagcgcgtcctgggagctcatgtagttcgggatcaacccctccggacttgaaggcggtcgtgcctgggttgcttgttgagagcgttgatctatggacgcacacactccctcgtgggctatcgcgctgctggatcgtcgacaatcgcacacacctggcacgttgcacatacatccgcttggcagctgctctctggtgaccaagtgccttagtctggcaaggacatccattggtccgccctcggcatatgcttgcgcaacagtccatgctgagatatccttcagattctctgcgccatgggcttggctttgagttgatccttcggtaggacagcgaccctctgcacgcctagacaaaagcgggttccgtgacacgctccaggatccgttgacgtccagacttgaggcgactcgtccactcgcggatctgacgaggagcttgtcggtgcttgagtgcacgaataggttcgctccactgtagagacacgtgttcagcagcgatgaaaagcaaactagactaccttggtactgatcgcactgtttgacctcttctatcaacacagtatttacgcctagaggcgcatctgcccaggagtcggatacgagacctatgcggccagtcttgcctccaaggcacccagaacaagccttggacgccagtttgccagtgtcggacgtagcctgcgtgtcactggtgtcatcagcgtcagaacacgtggaggctatcaaggcgacatgatgttggtacttcagcaaacttgctcagcagaaagaattgtaaaagcaatataaatagttgcatgcagtcttattacgcttcatttgggcagaccctgattgctgagaggctgttgacgagaccatggatcgactccttttatagcgtgggctgagatagcttgctcgagtagagagacacaaactggaaaaagtgggaacttggttaacatgcatgagatgtaaaaatgaaattggattacatgagcgtctggcgggagtggtaaagaacgaatggaaacaggcgatagccacatacctgtctcgctgatggggttgctgggagagaaggctagggaggcaggcgtaaggtctttttatagcgatggagaataatccagaaaacagtacagaggggttgaggatcatgaagtatcgtattgaatgaatggcgcaccgtgtgaaaaaaagtacggacaagacctggatcctgcgccgtgcggagaaagaaaagtttaacgcccttagaaaacctgcaagtgattgagcattgtcctgtagtgcagactttccctgcaggtagaaacaatggaagaaggaactataccatgcccgacaggtcacaacaaaagaaaaaaaatgtactgagtttgatgcgcgcgaaaagggttttgggataggagtggatgttactcatctcgcgcacagtcgacaatgactgacgagcttggctcctccaactccagtgccgagtctgagactgagcttttgtcagatggtggattggtgaaggacgtctggcgacgatctttttgcgcagctgcaacccacgaatacaagacaccaaggctcatcggctagctgcccattcttggcgcctaatacagcttaggctatagatgatagaaaagctggcagtatctgtgcctaatcaggacagaattaaccgtggaaggagcatggctggttcgtgggatcgtgggatcgtgggattttgggaggaggtgcagcgattcagatttgatggcctgggttactcaacatgccactcagatcaaccggcaacgatgtagctatgataactaggagggccgcgttctcgttcttggtcactgagcagggtcactttttgtttatgttggctatgtagacacaaccgtgcatcgggcattcctcgtgctgtgcgtgaaaatcttttccgacgtggttaactcaaattgcgtgatttttgattgtagagtgccgaggaacatatttgaggctaagggaggaaaagcgatcgctcaagcggtagtcgtaagcgcaatttgtcctagactgatgtcgatcgccgactgagtgtccacaagacacgaggacataccatggttcgggagaaggaaaatggcaggcatcacgggattgtgtaagcgcgaaactgtcaagcgctagtgcatgaaatggcgcgaccagggaaggagacacggaatgtgcagggtgtggacggctaggagaggaacctctttctaaacggcgtacacgcaaaggtaaaagcgggggagcgtgccacgcgtaggtaatttgaataatggacaaatgagttcatgcacatgaagtgttttgtagaacgcggctattgacagaaaatatgcacaacgcatgtagactgaaaggtcggaagggcagctagcgcgaaatactaaccacaatcaaagagagaaatggtatctgggcagtttcacgcaggctgtttgcatgaacaacatgacataccgtggggtgatacaacttaataaagcattcaccagctgcttgtggcgactgaaaagcatcataatgtgttgaggatgaaggcatggaccccccaaaataagaagaccgaccataaaaagcagctgagtagttttatacagtaaaccatgaatcatggtcttatgtctagtctgacatgagtgctgcaaacatggactcttgcacgaacgatgctgccttggtgggtgcgattcgtggtgacgactctggtgatgaaattgtggacagcggcggggacgatttcgtcctggacgatgacgatgcttctctagaagaagccgcgttttgatccacttgaccgccgtcgtcgttgttgttgttgtcgccgtccatatcctctcgttcactttgcttttttggctgcggtggtggcatggcggcgcccgcggccacgagtgctgggagcgcctctagtttttcgagccgcttgaaaggcatcattttcacaaaggtctgatccgccgagcgattagctttgagcacacagccagccttgagtttctgcagcttggtgtcgctccattgtgtggcgatatagggcttgttttcttcgctgaatactgccgccgtgctgatgctatcgttgtcatcgctgtccagttcatacgagaatccatttgcgagtcggcgagcgatcagtccaaccatccgagcgtcacagatcccgctgtgctgtcgcccctcaaaagtctctcccagaaacttaagcatgccttccagattcatccagtggatcagatcaaagaacgtccggaatagtgttcgaatgtcgaggtatgactgcgcaaaataggaaggtcgtagaattcccgaatgaaggcattgcttgccgataaagtcccggatgtcgaatggaccgtctgtcacgaagcagaaggtggcaccgtacgaaaagtcgtttatggctgcggcggactgtgcgtgttggaatgggttgttattggcgttgtttttcttgccctttttcgacttgctcttctttgctcgtttgttactggcgtggtttccggtagagtctgtgttgctgggtggggtatattgtccaaggatgatgttgtgcttggtgagccagccctcaaatagtgagagcacttccgtgaaggtaggggcttcgtcgatcgtttgctacaaaggatcgacaacgaagtattttggtgagtaatagggtttgtcttataattaatgacgcaggttatccgcacaagtgaagcctcccatacctgtttaatgccagtcaactcgatgcaaaagtcactgagaataggcctgttggtaggcctgacgtacgagtggaactcgtcgacctaacaagtgagtatagggtatgacgtgttagggccagggttcgatgtttcttgaattgagatgtcggcgtgtttgacgatggttttttttgtaggttaccacttcgagtgatgatccgtctaagaggaccacagggaactctatcacttcgttggggaattcgaacgagaatcctttctcgcatgtagcttcgacatcgaaacagaggtagtagtcataccgactattcatgtgcatcgttttccgtgaagtctgggcaaagtccatagcttgctgctgcgcgctctgctcctgatctcgatcctgtggttcttcaaagtccagatctgtagaatcgatgtcatcagcaccatttgccgctgctggatcattcgtctgagtagactcgctctgcttggactccttcttcagatgtttacgccagcgcgccttgagggttgacttgttcccacgagtgtcgagtcccaactgccgcagctgttctcggatgtcgtctactgctgtcatgatatagtactaatagcgtcccgagtctggttgtggtccggaaagcagcagcagcaggtacgaaggagtgacagggtataaagtgctttggatcaggagagtcaaagagcaaagtgctttttcgcttttttttcaaggcagggggcggtggcttgttcagtacgccaccaacgtgtcgcttgccgcagacgatgtcttctgggccattggaccttgccgcaggcagccattggagcagatcgtgcagaaggggcaccggctccgtttgcatatatcctgcggctggcacattctcggtccttccagccggcaagcagccctggcccagtaacaattgatattccttgtcttggacataacgtctccagtctgcacgcaaccatgatgcacgcacacttcacgcatttgtctcgtgctggatttactaccgaacttacagagtaaaaatacgtgctgggctgctgtttaatccttgggaaaaggtttgtagttgcttccgagcatgggtcgtgaaccttaagaaaagagagaaagatggattcagacaggaagctgcgcgaagtcacttttctgagattccctcgatttagacagcatatcccaaatgcacaccgtttgtttctccctgtggccgccacatggcgaaagcaagatcttggctgctcccacctcgcccaggacacgttgtgcgcactaggctgaatactgacacgcgtagatactgtagtatgcctctatctggcatgagcaccctccagggaaagcattgcgcagggtgggcatgcatgcaaaggacccttggttcctggactgaagaggcactttgatagccagggtggagaatgccggaatcaccgtttcccggaactcccaagttgggaagtggagaaggaaaaggatcggcgctggtgactgctgttgattgagcactttcagcttgcctggtctatttctcattcactttgcatttcgcttctctgcctctctcctttctcccgcctccactgcgcaccactgctccactctccactcttcactctccattcttcatccctccactccacactacacacccgaacgacaatgcgtcttatcaagcaaaacgacgatgacgctgctgccgaggctgccatgcgcggaggtgccatcggtgccctcaagtattgcacagtcgccctctttgctggcggcgttctcaatgccacctggccaaagttcagagccatcaggcctccacagaaggtaacttgcctttgctcaggtcgcagcactgcttccttcaaactcgcttcacaaccatgacgtctaacgggaccgtgggactaaaacataactttatttctatcctctcccccccccctttcatcagggctggttgatggtcgctgcattcttgggaggcttcggtaacggatcggacactgcttttaccaactttgagcgcagggacagagagcttcagatccgcgtggccaaccagcgtcgccacgagctcatctacggtactgcagaggagaagcaggccgccgccgccgccttgtccaccccatccgagcccaccccctccgagtccacgcctgttccagcaccagcaccagcatcagcatcagcatcagcatagacaaattacacttcagccctatcagcgtggaataaagaataacctcaccgacagagcaattctggggggcatggtgtattgcacgctcatgacacctgcacgctcatgacacctgcacgctcatgacacctgcacgctcatgacacctgcacgttcatgagatgacgctttgcggtcatcgcacaggaataagctgctttttttttctttgtcggtatgccatgatgatgatgtattggatctgacgatctaacgcgcggaaaagtgctatgatacaaagtgttctgtctgggtgatccgtgtcgtgtgtttctcgatccttgtcgttctctcctccacagctcaccccatactaatggtgccctccaccacctccagcagcaggcgcctcgccacctccagcgtctccatggtcaccgccaacgctgggggcgtggaaactagagacgtcatagtaaaacgccatggcacacataaagaaggcggccagcagcaacccgccctccaaccaattggtctcgttgtcctggatcagatagttgaccatcaagaccgagcccgccaggatgacggcctccatcaagctgaagcggaaggtcatgggctcatcaatgatccagcccaggaggatcaacagtggtgtgaccaaaagcgagatctgcatacagcttccgatcatcagcgccacagaccggtccagcctgttggctttactctccttgatcgcaatgacttcttcctggagatccgaaatcagcacaatggggagaagcacaaagcccacaaacgaatcattcagattatactgtttgccgagggcttcgaccgcgtggacgaggaggttggcggagtagatctgagcgccgagcatgacacagtaggcgaatccagcgaaccagtaatgggtgttgcgtcgatggagcgtgtgttcttccgcatgtttggcttctggggtgaccataaagtgttcggaactgtactggaacaggagacagcagccgtacaggattaacatgatcatggccatgactttgctgatcgtcaggatgtcgtgatcgacaaaggctcgcgcggctgctttggcctccaagagtttggtgggcgtgaggttgtctgggatgagggcttcttgaagttctgtaaaggttgcgtcgagcgccacgggtataacgtaggagatgcagacgatcatgaggagattcattcctgtttgagaggtgtctgcttggatgggctgctgttgatggtaatatcctccgacgacgaaagtgattcccatcatctggataaggtgtgtagaatgaaacagtgattctttgcgtgagtggattggacattcgaatcaaaaatagcacaaaaaaaaaggggggggagaggcgtacaagaaaagagaaatcctaccagcaacaaattgttcaagatggctccaagcatggcagcctgcaccactcgcaccaagcccttcatcaatgcgaatgcagcgacggccaattcgaccgagctgctagtcatggcatcaaagatactgacgacacgctaagacgagaaaaaaaaattgggcagtttcgattagctgaagtaaaaatttcagtagtgattacgaattggggttgccctgtccaacactgcacttaccatgcccaattttggaacaagctcctccaaacatgcccctgcagccttgccgagatgcatcatggcaaacatgttgaggataaacactgtcacattcacagttttactcatcatcatgtcctcgtcccctcctctcgccttgagatgactctgatccttcagttccttgtcgtgcttcatccgagccgtgatcacatacggaatgacccatccagggatgatcagcagcaccagaaagaatcgtctaaagaacgtccgcatcgcatgaagattgtcctttgtgttcctgtacgggaacaggttgcgatccggtcgattgccatgaatgaattgatccagtgtcctgtgggggtggtgatgatcaccctccccgagctcgtctccgtgtccgtgatagggtcgtccatacatcttttctgggctgtgctcgtctgacagatcgatactggacagagggacgttcttctgtgggtggtgcgaaagagcatccatctcgatattctctcgattcggctcataagtcgggcccagcagtcccgaagtgtcctcctctggcctatgagtcctgaatgacagccgtgtctttcgcaaagtgttcgtggccctgcgattgagatttgcatcgcctacgcccacaccgctgtatacttccgatgcagagggagaacttggagaagctggaactgggtattgttgctgctgttgttgtcggtcgtcatcgttaaattgcagatgtctcagacgcgatttagtgacaatcgaccgccgaggccgtagctgccctcctgtcacagaccctgtcgaggaagaatatgagagagagctctggttgttgttgtcagcgtcatggttgttccagttgcgccgagacccacggcgtgccggccgcgcaggtggcgctgcagaatgggattcagctgtagctggagtcaagtagttggacgttgacgggccttgagaactcgagacactgttgctgatgtatccgtgtggggaaagatgagacgaggactgaacctggtcaggtggagctatgtatgaggtggtcggagctgaggaggagatccgtgctggcgtcctggaaggcggtggatcgatctggaagcggacagagcccgaggagagattggacatggtcgaaacctggctgtgtcgataaggaagagggttataggaaagatgaaaagtaatgagcaaggcgaggaaggaaatcaagagcgagggaaggaggaaagagggaaagaaagagaggatggaaggtagacgaatgaatgggatgtggtatcggtggcagggtactgtgcatattgtgcccctggttcggactatctttaaattggcaatttggtctatttcaacgactgaggaggcgaaagcgaaggggaggggtgcaaaaaagaaaaaaaaaaggcgacagcgggacggcgtacagacgaaggcgcaagcatgcgggtgggtggaatataacatgtagaaggcgaggcagggcaaaagtgacagagaaggggaatatacgagacatgagtaaggagagctttcagtctcatggacgagccggcgcgatgcaccacacacatgcgtttcattgctcaaatctgtacaggcaaacgtgggtaccttgaagatggtatgctgccgctcaaaataaggtggcattccctttgtttgtttggcctcgttcccggggtgtcgaccgtgcaacccgagcgaacgaatgacccagcctggaccatattaagccctgatgaatacaaaaccctccctcttctgtctttttcgcacccacagcaaagcatggatgggcagtggagaagggtccgcgcgcagctgtgcactgtgattccaccagcctatccagtcgactgcaaagtgaggcagtgtctacgctttctcagcgacaaaggcggcgtgcggctcattgccaccatgggccagactcgtgtatctgcgcaacgtactgtgtactccatccaccctgggtcttgcagacgagtcgatggacgggaaaagaacgaaattttgggccccgcgatggaagccaaactttatgcagcagacagggtccagcgtcacggcgtacgataattgtgtgttcaggtgcgtatgcaccatcggtatttccatcgctgactgtggctgggaaataatggtgcctgagcagcaaaaacgaagatttggcgcagacaatcaatccatcgtcgacgtcctgctgcatccccttcctgttctctgccgcctgtccttgctgttctctttcgtcttttatagttgttgcggtattcttgtacattaaatggatctgcccctgtagtcttcatgtcctacacctccctctggattcttgccttcaacactccaattcagacctactcccgagtacactagttaccataaaacaaaagccatgaatcacgaccaaccacggccagacgcagaggacacggtgatggaccagacggctgcagatcctggccaacgtgcagcaacccctggcacgcttcaggaggcagctacagacgacccaaccatgctgaccactgcatcctccacaaccaccacaacaacaacaacgacaaaagcaacgaccatcactgcgtcctttacagtgccagcagtagccaaaccactgcccactccagctctgcccttccagtcagcgcgagcctcagagtctctcttcaccagcagctacaactcattcagtcgtgcggcgggccgctcaggagcatcagctgctgctgcagcctcggcagccgctttacaactccagagggaacttgatatgcagcacgaagtgttgggaaggaagccacagctcgcgcaggacattgttcccaaggagcctgcgaacccaccgacgtttcgtgactatggtgcgacaagggactggaggcgggagcagagtcgggatcgcagggatcgttccagagaacgggatcgcgaacgcgacaaagaccggtactccaggagtcggtacgacagatccaaggagagagaccatcggggtcgtcacagggatcgttacagccgcgagaggagccatgagcgagaccacgagcgggacagggactacagaagcgagcgcggttacaggaatgactatcgataccacggcgaccatgctggcgatcgcgactacagaggctaccggcaggacagacaggatcggcacgaccgacactatcgcgataacaaggactctgaagagcggcatcctcagcgagattacacctacgatgaagcaacttcgcgcgaaggtcagcgatacgaaggtgctgaaggtggtcgagagaggagcaacagtgcgagtcagtggaaagaaggtgacgatgaaggcgaggctcagtctgtcagggctccttcaatcagagcaccggactatcgctctcgagattacgaccaaagggagagaagtcatggacgtgaccgcggccgttacaggagctgggatagaaaccgaggatacgaccacgatagtgacaagtacagacaagaatgggacggcaaagacagagcgcctcgggaccgaactctcgatgctgataggaatgtaccaacggacaacgctgagcaacatctcccccctcgtcgacccagtcatgactattcagctggcgatccggcccaagataccagagcagcgaacggaagttctatatcagccgcatccgcggcgccatcagcgccggcagcattgcgcgactctcttgcatcaggagcgacagctacagcggttgcagctcgggataccctcgaccctgcggctgtcagtgagaaggcgcagttctcgggaacacaatatccttttgtgcagccagcaggagaggcggcacagttgaatgaatcccatcaacaaggacagggtccccaggtaaccaagtgtcaggaaccagcagcaagctccgactttccatcgagtgagactgctgctgccccagaacagctgtccgcacgagagccacctccacctccgcctcttccacctgtcatgccgtcagtattggcccaggagtccattgggggctccagtgtgcccaacggcaacgctccgccgccaccaccaccactcccgccaatcgcccctccacgccatgaatcacagaccccagtcataccagcatccgcagtggctgctccagaatccgcttacccaccgccctcaggcaatgcgccgcctccccctcgccgatcgatagcggatgatgactactatggatctcaaggagcccatggtcactattaccgtcactcaaggtcgtcacgcgactaccgtgatcgcgaaagttggcatgggccagatgcggatcaccgttacgacagcagacgtcctcatagtcgttattactctcaatatccacatgagtatgatcgacacagtcgcgcaccgtctcccaggaacagagagcgttacgactatagccatgtcgaaaacagtggccataggccttccaatagcgcagatgtcggttacatttctggatctcaccaggacatgcatgcacctcgacctgatgtacgccagtctccttcttcggagcatcttcctcctgcacccgcaggatatgctatgccataccccccagtggatcctgctcaacagccagctccatctcctaccgtggcgcctatgctcaagggagaggacctgtacgagcgagttggccaagtgggcgaaggcacctatggcaaagtgtacaaagccaggaacaaacagactggagagtacgtcgcgctcaagaggattcgcatggagaccgagaaggacggggtaagcaactcgctttgcgcgtgagatattgtggagataggttcattcgcgcagttgatgagactgacctgggttttccatgatgatgtgatgatagttccctatcactgctatgcgcgaaatcaagctgttgcagtcgctgaaccatagatatgtcgtcagcctcaaggagcttatggtttccaagggtgccgtctacatggttttcgagtacatggatcacgacctcacaggaattcttgctcacccaaatctaaagttccgacctgagcacgtcaagtgccttatgaagcaacttttggagggacttggtttcctgcaccacaagggagttttgcatcgagacatcaaaggtatagcggagcgatcggtcaacccttctatcgtgcgttgtagtcgacgttgtatctcatgtcatgtatgtcttttatttttgcgcctattgtaggatccaaccttcttgtgaacaagctgggcgagttgaagctggcagatttcgggctggcaagagtgttccagaaaaagaccagaagggactacacgaaccgcgtgatcactctttggtaccgtcctccagaactcattctcggcgcgactgcgtatggaccggaagtcgacatgtggagcgctggatgcatcatggtcgagctgttcactcggagacctatttttcagggacacaacgagatcatgcagctcgactgtatctggaagaccatgggtacaccgcagaaggagtcctggccaggtgtggatcagcttccttggtacgagctcatcaagcatgtgaactctgagaacaggtcgtcgagatttcgggaaatgttcagcaagtacatgagctcagcagcacttgatctcgctgaggccttgctcagcctcaaccccaaaaaaagacctacagcagccgagtcccttgccaattttgcttactttacagaggaagagccggccgcatgcctcccagaggagtatgttccagtgctttttttggatgccctgagccgttctcgtatcattgctgtgcactgtactcacctattacttgcgtttgtactaatagcctgcccaagattgagggtgactggcacgagtacgaatccaaacaacggaaaaaggctaatgccaggccgaaggaccagcagcattccacccaggcaccgcaaccttcctcgcgtcagccaagtgacgagatccactcggatcgcacggaacaggacaagcaagggcgtgcgcctcatccgccagtgtctaaaaagcacaccctaagtggagcttcaaaaccaacagacggcacaacatcatctgcccccgtcgggcttgtggtcatgtcgggaagcagttctgtggagcccacagtggccgttgtcgagcaagtgcccgatgctgtcatgggcgcaccaaaaatcatggaacacgagtttatgcctcccgccgtgtcgccatcttaccttccatactcgtcggttaccgccctgccaagaccatcggatgcaagagcagcagactatcgaggagctcctcctcaacttgctcaacccactcagccatacctcccacctcctcccccaccagttgctctaccgccctacggcgatggatctttagctgagcagcagcatacactgccgtacccgcacgatgctgctccgttaggtcgataccacaatccttctggagcctatgactcatccagggcggaccattcagcacagccaccagcacctacagcactctcgtcccagcccgtggacgcttacatgactgatgcacatcgcagatcggtgagcatcgacgaatcacgccgctcatccattccaccaccttctgggcctgatcatggcaagagctatcatggggaccatggctacgactactatcaacgcagccgacactatgactacgcaagagatcgcgacaggaacagggatcgagatcgacaccgtgagcgtgaacgtgattatggacgaaggagaggcgactatcgccgagactggtcccgggaccgtgaaagggacagaggcagcaatagcggacgagaacgggatcgggactatgatcgttaccgagaccggcctggacgcgatcatgggcgcgatcgcgagcgtgttcgagacaggagtcacgacgacgaggaatattatcatcgagatcgtgtccgggaacgcgagagggatggagatcgaggacgcgatcgagagcgcgagcgcgagcgccatccaccagagtacagcgcaggtggagggcatgaccacgaacatgaacgaacgcggagctatgacgtggatagggatatgcaggaccgtcggatagatcctgaggctcacggtcggcggagggagcgatctgagggcgttggcgaggatgagagagagaaggcacgtgaggtcgatccaggtgccatggaaggacgcccgcagggtgagttcccaccgccgcccaagaagctgaagatgtcgacggactcgtcgtcactgtcgtctccctcgacaaccacatccttctcgtccctgacgtgagggagtctgtactatcccttttgcacgatccccaagcataataaaaaaatccgagccagaccaagatcacacacagaccacaggtaccaagcgacaaggtcgcctgtgacgtccagaccgagaacacatattttctgtcctactgcacgtccaccctctgttctgtcgcccactttcctcgccttggccgactgttgtgcatcttgtctacagccgcacagcctgctgtcttcgctcctccagcccgcctcatcagcactctgtcacccccatcaccactaccgctagtgcgtgcgcttcttttgcttcgggcgaccattcattcctttccgccatctccgtgaacaacaacacaggaaaccccatcaatgcagtctactcaggcccagctgttggctcgcagcaggagcaatggtgctgagaagaaggccccgccccccatcaagcccaagcctagcgcgctggcgtcgtctgccgtcgactcttctgcgccctcgcccaccttctcctcgtcttcgtcctcgtccgtcgcgcgaatcacaatcacagtcaccgacaacggcttgcccacctcgagctccttcggggacttgaaaaagacctttgaacggcaacagaacagctcgcccctgttcctcgggggaggcgcgggagtgtcaggagtgggtggggcaagcccgagtggcggccatcccggccacgcgtccatcgcacgcgtgcagcaacaggcatcgacctccctgagtgtgccaggagtaggcagtaacagcagaccacggtcgttatcatcacctgcaccgcctcatcgcgaaatagtcgagcaaaacgcctttccgtcaggaacaggctcctcactggcgtcatcggctgtgcctccagccggagaggggatagatcagagccagcccgactttggcaacctccgcgcccgcttccaatcccaggcctcgctttcaagcgtgtcactacccaggccagtaagtttacttgaggctgcgcgcgtttagaagcaagtcctttgttgcatgatgcaaacgacgcccgatcagcagtggagccaggccctttacctttgcttaacattcattattttgccttggataggatccaccaagggcaaagccaaagcctgcagcgcctctgctttcgcactccccacaactcccatcaggccaggcgccgcgcatgtcactggattcaagtaggagcagtgctatttcttcgaggttcacgtctcctcagcttccaccctcaacaatgtccataaagtcttcaacatcctcgccgcgtctgtcatccacctcgatgaaacaaccacccaggccgccacctatcgcacccatgaagtcgagcttcggggccaagacaccaacaccaccaaggacaccgacccctcaacgaccagagtcgcccgaatcagaacggaatccgttcatgggaagcgatgaggacgagccctccgctgctggacccgcccttggccgctcaacctcggccccggttcgtccaatctcgaagatccaacagaatcccgtctttcaacaactgaacaacaatggtatgagctcacggctacctcaacagcagcagcagcagcggcccttggtgccagtgcctggcaggaacgcagctcttttgagcaaaatggcgcctccacctcctcaacggatggctcctcgaccagattcgccacagggtacgccccccaggctgccctcccgctccaattcggccatcctcgcggcagctgaagaaacgcctgaagaaaaggagcgaaagcatcgtctggataagagacgcagggttgttcaagagctgttggagacagagatcagctattccaaggacatgttgctcttacaagaagtatggacgaccagcattgcttgcactgctgaaatgcgctcgatgagtcgtgagctgaccaccttttgaggatgccgttttgtttcgttcctttttcctgtcgattaggtctatgtcgcagatatgagagagtcgcatctgttcacagcggcggacgaaaagatcatcttcacaaacctggcagaagtgaccgcattgacgctggactttattgcactgcttacgccggcatgtggggacagtacggatgggccatatgatgactctagtacattcgttggcgaagcgttcttacaagtggtgagcaattcttcattatccatgtttgcggtggcatgatgcaatcctgtcctgatcttatactacgcactaacccatcgctaacgtggtgtccttttgactagatgtcacggatcagacgcgtttattcagaatactgcaaacgacaggaggcatctgcgcagtatcttcaggagctggacagtcgaaaagaacttcgaccgttctttgaagagtgcacggaaaagtgcaaaggcaagaccacaggatgggacctggcgagtttgctgatcaaacctgtgcagagagtcctcaaatacccattgctcattaacgtaagttcatggctgtatctgagccgtggttgggaaactctaaccaactgggcttcaaagccatactcacgttcagtggattcattcttgttgacgctggcaacggtaatagcaaatccatgccctcacaccatcggagcatgcggatttcgagaatcttgttacggtgcaaaaggacatgctgcaggtcgcggaggagataaacgagatcaagaagcgcaaggacattgtcgaaaagattgtaggcagcaagaagaagaacgattctgacattgtgtaagttgatcaggctggatgcgcattccaagtattcgtttcgagacccgtccttagcgtttccagtcatttcctaaacaactatgtttttttctagccacggattcaacaaaaagtttgcgagaacaacacagcaacttcggcaggctgtaggcggatccgaagtcacggtcgatattcttttcgaggcccttttggaaaagttcaaccttcagcaacggcttgtccgcgaatttgcaaaatatatccaagcatggctcctctccatcaaacgtaagaagatccggtgctttggcgcttttgtaaggccaactgaaaggcagtacacgttgctaacagttctgtcgcatactgttttgtgcctggcattagaattcttcgatactcaagaggcctttgcgtcaaccctagtagagatctatggcatggttccggtgcatcggagtgatgagaatcactccattaccgttgtgaaagagttccacagaaatcttacccagttctcaaagtcgatcggtcgcgaactagagagccagctgaagaagactgtatataagagtatggagaacttcctgaaactattttcaggaccactgcaggtgatgaagaagcgagagaaaaaacttctggactatgacagtgtccgaggcatgaaagaacgcggagatacggtaatgcaacaagtacttgtcacgatatggcacgatgtcgtgctttcttgcttccagcttgtctctagtggcaattgtatggtctattaacgctgtgtaatcatacgatctaccgcctccctataacagatcgacaagaatatgctagagtcggcggcagcttatacggccatcaatgagcagctggtggatgaactgccaaagttcttgggattgacgacacagtactttgatctgattgtggtggagttcagcaaggtccagatgttcttttattctcaagtcaaggccaagattgtggattactacaccgagtttattgatccaaccgcgggcagagatctgactgcatatctagcgcagatgaatgtttgcgaggactatatcgagatgatgcagagatacgacggcgcgatcgagcggttggagaagatcactttgatcaggaatgttacttcaaatcatggtaatgtccaaatgctctataatttgcttcgtgcttgcaacgggcactatcccgagcttttcaatagcttctcatcatctaacatcctgcggttttactactccagcattggcattccaggagattcgtgagactgctcagcgacgccgacgaagcactctcagtctgcagtctcgttcgcgcagctcgtccaatgcgtccgccttgcctcctttgcagacgcctacttctggacaggcaccttggggttccaagtcggcctctcagcttttggcctcacccacagagatgactttgttggaggagccgctgcagcctcgctactacgaggatgataacccgttcgagatgcccgagtccatcttttcggatgattacgagaccaacagcaacagtggcaacagcagcatccggagtcggaatgttttcggctccagtggcatggcacgtccactctcgactgcttcctcctactcgttcagttctgcggccagtatggatccttctcagccacaacagagcgagagacccccggcactggatgacggcatggatatggacgagattggaatcgcgcaggcgttgtttgagtgcacggccatttatccatacagctcgacggaggatcgtcagttgaattttgaggctggtgagagcattgtcgtctttgggttgaacgaggacgggtggtatttcggcaagaaggtcggcaaggagcagactgggtggttcccagccagccactgtatccagatctgagttctgatcaaggacgcacagggaacagaggtaggcgtagagctgggagaagcgcgcgtccgccagcgtaccactcagcggcggtcagcgtaggcagtgggtggcttttcaaaaaaaaaaaatcaaactcgcaaaacaaagtgacttgcggcatatagacctcgccccatagcccaagtgctgccctgcgttgttcttcaccctcgttgtccatccgtctgctgtccgtcgccatcctcctcctccgctcgctttctctcttctgtgacgccttgacacagaccgtgagctcctccagtgcctcgacagactctatctcccataccccgctttaaaaaaggcctgcattcaacccacggaaaagcaaacgatgagcacccatggtatgcgccaccacaccatggcatcacaacaaaacttacttgcaatcaacgcgtttctcaacgtatctcgtcctcttttgtatctgcatcgtatagaaaaccgcctgtgccggcttatcgtgcgtgagcactttggccctatcgtcgaggtaaagtagcagacgcggggacattgtccttcttttttagaaaaactgcaactactcggagaaatatttgtatctaacgtactggcttcgtttttgcttgttacagaaagtagccaatgttctgatcaggaaaggccgcatgccaacaggaatgattgcccatatgacgcagctcaaaatccgccaggtgcgcgagtgtttgtttgtcttgatccagcacaacgtcgccgtgtatgcggaaacgcaggagaagagcaggatggtgacttattatgagatcaaccggaccgagttgcttcatcgagctatggttcccaaggtcttgggctatgcaaaggagtggttcgggaacgacggactcaagattgcacagttgatggtggcgcatggaaagcagacgatcgttgactgcatggcggatattctggcggatcaggagaagcgatccaacagggacaatcgtacgtttatgtcgcggatcacgccttgcttgtgtggactttttcatccttctggaaatgttttatgctcacacatctatcatctatcctcctctgtctcaacggccctgtaggctcggcaaatgtcaagcgggcgttcacaaacatggtcaaggaaaagattttgattgcggtgcgaccctctgactcattgaccgcagcagacaaggcaatggcagacgagaaaagagagacggacaagatgacactgcctcctactgcggcagaactggccaccattcgcaagactcttggagcgcaaaagactgctatggatcagagatctgacattgttggtttggtaaggatttgatagtgaagaatcaatgtgctcttattgctagatcgacagtgtagtcttaccaccgtctaactacttctcatttctgctgttcgtatcatcttttggcacttctctagaaacgcactgtgaatgaggcaggctatgacgattacaccatggacaagcgtcgcaagacagattcccaggagttggtgatgattgaggaggtcgaaacggacgtatacttcaagattaactttgagagattcacgatccgttggcgtaatatggtaagggcactcgactgtcacgattcactggttttttgttcctccttctatacacgatctgcgtgttctaacgtcttggactttcattgctttcctctttgctttatgtatagcacattgccgaactgtacgaagatcgcctcaactcaactgcggtgaaaatcatgaacgggatcttgtcattggcagaaagtaggatgatcaactgcaaggaggagcgctcgatcgccgttagcaccatgcaggtctaccgtatgctccccgaggacttgaacgtgggcgacacgctcgaactgatgcccggcgaactagttatccccaggcctgaagacaagagcggcaagatcaggttccataacgagtgcctggacaagtacatggaagtgctcgagggcgatctgatgcagctcttgaagaaggatgttggacggtcggggcaatacgtggtcgatctcaagaaggcggccaaaaccttgaaaagaaagttgatccaggacgtcgtcatgacccgttttggttcaccttatgtccggatcatgaacctgctgctggacaagggcaagctggaggagaagcagatttcgcggctgtcgatgttgccggtcaagaccgtgcgggaaaagttgacgacgctgcatacgtttggggtgctcagtctacaggaggtgcccaagacgacggatcgtacaccttcgaggactttttacctgtgggaggtgctcttggatcgggctgctgattcgatggcggagaagctgtatcagacgatggccaatctgcgccagagacggtttgcggagaagatgaagcggcaggttctgctggacaagtgcgagcgcacagatgtgaaggagaataaggatctgttgaacagtgcagagcggaaggagttggacgcgctgaatgggatcatggagttgctggaggtgcaggagttgagagtcgcagagatggttgtcaccctgagggactattaggctgcaatcgtactggacaaataataccgttcagtctaaacacatacagcaaaaaaaaaacaattctcgacattctctgctctttttctgtgcgcgtgcaagcatttgatcgttggtatgaatacgtcttcaagcatattggatgctttcagtagccatttcggctaccgctgtgtcaggatttgacaacgaagcatacagcgtcgttcaaccacatcgtcccaacggtaaactgccagaaatacaaactactgcgatcacctcacccctctgagtcttgtactctcactctcctctgcctctcactctcctctgcctctcactctatctgcataatcaatcctaacaaatacacagagcattagtcgccaagggagggcgcatcagacgcggttcttcaaaaaaaatgtcgtaaactaaagccattaaaaaacctcccaagccgaaagtcttgctgggaaaaatagtgacacccccctgcatcatgagtgacagaagctatggaaaagactacggagcgaacctcgcccagtgcagagttaccgtggactgggccctctccttgaatatattagcgtagtgttgagccctttgtctttgggccgtagggctgtagaccagagcgtaatgttgataggtataccgatgtcctgcaaaaacgaaaagaggtcagcatcacgtacccaatgagagctgcttccctagggacgggagtgtttgattttcatgagggcgcggttgccaaggcttaaagattctgatgagcacaggtaccctttctgactggagtttattttcagagacagaagaggcagtgcagacaggtaggtggagtggttttgcatgcattacggaacgcgctaaatggggagtctcccctcttgggcgtttgtgaacgggggaccaacgtgcataatgtccagcgtggaagggggtgacacgcagagccaagcgggtgttttgcctccgttgttctgattagaattgagaaattccattgataaaaatctacggaagtgataccctacgcttttatttttaccactccatcctgcacatgtgctgctcggagcaaaaaacctctatggacgcatgattcgtagttggaccttctccaacacaacgctgcagacccatcgtcctgactatgcaaactgccttgaactgaaaatctaggagagagtcagggtgtaaaatagatcaattgcaatttttgtcaaagtagggcgagggatcggaggaaaaatccaatcaagtcaaggtgggcgagggaaaggagaacagaaaagttgtatgaaagctatttcacaaagggcgagggtggaggatgaggaaagacacacacgctggaaaaaaaacgtataagaaccgttcacgacgagcgcaagaaaaaggttcatcatcaacttcatccttcagagcaactactctcttaccacttcagtctttcaaaaaacacccctcctcaacaccctcaaccaaaacccaccaccccttccctttctcaacatgaagttctcgatcctcgtcacagttgccgccgccatcggcctcgcttcgttcgccgaagccaaggcctcgagcgtcaatgtctacgcccagaccgacttcaagggacagtgcaagaacgctgagatgtacaagtacgaccagtgttactcgacccagaccaacaagaacatcaagtcgctctactacaaccaccaggatgctgctgccagcgagatcacgatcactctctatgagacgggcacctgcggtggcaagtacacccgggccggtttcgacgtcaagatgggccaacactatggctttggagcgctccaggtcaacggtggcaaggtcggctccatggttattcacaagggcaaatactctaacggcagcggtgtgatcaagcagaagttgcccgccacggctgccaagttcacctccaagtgcaccatctaaggagaccttgttctgttgctgttgctgcgaatggccatccttccttttggaacccgtctcccttcgtaacatcaaaacagcacacccaccatagagtgccttttttgttgagaagaaaactataaacaatacgaaaagaaagacacagacaatagaataaacacttggacgagggctggataagtcctgcgaacgagcaacagcaattatttgcttaattattacctatgcctttaggaaacaggttgtacgagaataattgatgttttttcctgcagccttgtcggcttcgaatatcgaaccgtgggcgcaggctatcttcccatgctttacatacatcgatttgtaacaccagaggagtctggcacttgcctctagtgacttttgtagcgtcatttttccttagacatttgtagacgtgtccaagcttcataaaccactctcctcagaataccttgatccgttctatgggaggggagtcgtctactgggatgttggcggctttcgcgagcccgcaccttttgtccgcacacaaagtgttgttgtcgatgctgtcacggttgcctcttcttgcagtcgactcaactctatcccattggatagcacgaggaaggcatgctagaaaaaacgtgacttacaaaaatgtgacatagcggtactccgatccatgcgcggataactcgccccttcgctgttttccggaacttgaagctcggaaatttccttacgagctgtccattgcacatcctctccactctcaccaccctacgctctctcctctcacaccctccatctctgccccatcatgtttgccccccgtgttgttgctcccttgaagagtacgttttccttggccaccgatggcgtcggatcggcctcggccgaggcggcacagctcttcggacctgtcacttccccgcacaacaacactttctaaatgcgtgcatcggattcgggagcaacaacaaaagcttctttgggccgcgcaccaggcatcaaccctccaactctgttttgacaccctcctctttctctctctctcgtctctgctatctgatgtattatagcctcggtcttgactcagtccgtcttcgccaagacgcgtgttatggcacccgttggcacaaggtatggattttgacacatgaaagcaacaaggagccgcttacatgatttatcaaggatgctggcgtagtcggtctttgcacataaggcggtttctttgatggcgatgttcaactacagttttgctcacctctgatgccattgcctgtgtagaatcttgtcgacttcccagagcaaccagcgcgaggttacagtcgcacccatcattgagcagcgcaagaaccgccctctcgcacctcacctgagcatctaccagccccagctcacctggtacatgtcggccttccaccgtgccactggtggtgccgttgctgttggtaagcatctcgatttggctatcaggagtgaaacttgacgctgaaggaacaatcggagagagacaattgcagaacaggatattccgcgatccctacttgcagaaaggagaaggacctttttacaacgcttttctttgaatagagacaaggctgatgcacgcgatggaagatgaatatcatgaatatcgactaatatttttgttctttttcacacttctttttcaggattctacgcaggagccatcgcctatgcagttggacccatgtttggtcacggatttgatgctgcctctgtcacctctcttattgccaccgcccccgttgccgccaaggtcggcgcaaagttcctcgttgccttccccttcaccttccactccttcaacggtattcgtcatttgctctgggacactgcccgcggattgaccctcaagggtgtctacacaaccggctacactgttcttggattgagcacagtgtctgctattggcctggctcttatctaaacaactcgaacgacgcggaaggacgatggcgaaatggggatacacatttgtgagcaacaccaagtatcatttttttttcttgcacacaaacacataacctcggaaacgaacaataaaaaaaaacatgtatttcataagagtcaagttgcaggaggcccttttgaagccatagcgcacctcgggatcgatgttagcccagccaaagttcgccgcagaccaagacttttggcaaatacagtcacaaaaatgcggccgcagtattcagcttctatagaagtgaagtcaggactcgaggacgcttctactccccccaaccactttgcacatcatgtcgaatcaggatcagtcaacgcaggaacacaaccaggagagtatggaggatgaatttctggacgagaccttcgacgacggggacggtggtgaggggcaagattactatgacccagaggatgatcttgcctactttcatgacgaaaagtggcgcattgaagagtcgtggctggaatgggaacggcaatcgaccgtcaacaaccgtcagaaccctggattccactctcggtacaacatttttcaaaaaccggggtctgcgaaacgaagggatcgacggaatttgaacgctcagagcggcggtagtggtagcaatagccgagctggatcgacgagttctctaacatccgcagcagcaggaggatcgatgatgcgaccagctgcggaggaggccgctgtcgccactgctgctgctgctttggagctggacagatcacactcggcggcagaagtcaaacttcgacggctgggaacttatcgtccggccttggcgaattcgatcgtgcattcgtactcgaacttgtcgtgggaagcaacgcaggctgcacgcgaacaacggttggcagccaaggcagaacccgatggctcagggtaaaacgcgcgattctcttgctctgacacggcagcttgggctcagagatcttttcggaagcagctgatgaacttacaagccatgttacttttcttttgtagtgtgaacattctttgtactatgcccgtcgagctgctgtctcatatcgtgtctcatttggaaccaagcgaactggtagggacaaaaggccgtgactctggatgaactcatggctcagcattgttgaaactcagtctggaacccttgcatttctttttttcttggtctagttcaacgtgtcgctggtgtgccaactgctctaccatgtcgtcaatgcggattcatgttggaaggaagcattcatgaagttctttggagcctcaatacctttcaagcgcttggaccccaggagttggcgaggagaatacattcaacggacaaggctgctgaggcgctgggaaaagggtcgcggctccaatattctgatcgaccccaagattggccagatctcgaaactgtggtcgcaggtcgacaacagcagacctcagcaagactggttcttggccggaggcatcgctcagagtgtggtggcacgctgcaatccattgttgggcaaggtgaacaaggatgcagttttccgcatggttcatcttgtcgatgtcgaagtgtcggtcatgaccatggaccagtaagtatttgtcgagtcgtgcaacatctctggtatgtcgcgatccactttatcgccgctgcggatactaaaccagggttgatcgacaggcatagagttttgtggggtctcaccactgggcaggtgtcgttgacaacgttagcacacgcagcagcagggcagacattccagacctttgctggctttcacgaggcccccgtcacttgcgtgaaattggtcccaggtcacttggaatttgtactcacaggaggagccgatggcattgtccgattgtgggacgtgtccaaggcacgcactgtccgcgaattcagaaccaacatgagccctccgacggcaaggatagaccacatctgctgtgaacctggatcgcgcattgttgccggactatccagtggcgagatctatgtttggtccgtgaacattgcttccatcatcaaaccagcgtccgcacctaattcaggcgtctctacgccagcgggaactacctcgttagacaatgatggcctggcgacgcaagccgccacacccgcagggatggtacccgatctcgggggtccttcaggtgaagggttgatagcgcctatgacctccaaagtcattcagctgcccgaagagctcaaaggcgttggttatcttgaggtcaactttggagctggtggctctggattgatcttggcgcaggctgtggacgcgcccgtgatgcatctcttcagcttggagacgttggagcaccttgcgaccttgaagagcccagcacacgtttcacccatcaccgcggtccattgggatgttctaaagtacgagaggccgatgatctcgcagtcgaatggcactcgatccctagcccactcgtcacatcatgttcgaccagagatgcccagccttttggccaccggtgatcaggctggcaacatctcgttgtggtatctgagcgacattctgaggcgtcacgagctgcagacgaagaagcactatcttcattcgagccagaccaacttggtgccgatgatcttggagccgacgtgtgtgctgaagggacatgatacacgggtgtcaagtctgtttgtggacaaactgttgattgtttctggaaggtatgggcacgacgaaaaacgcaatgtagttgtttgcagaggatgggaacgctttctctaacagtatttctgatcgctgtagtgctgatggctgggtcaaggcttggaatcctgtcaatgggcagttgatctcggtgttgaatagcgggtatgtattactcatgcactttcatggccaatgcgcgttgttcgaaaagcaccttgtttcaaactactgatatactgattgccgttttgtttttttaatcctaaacctacagctatattagaggacgcgagttgaacgatttgaccagttcggctgtcaaatgcatggtcatcaacagccggaaatgccggggcgttgtgtccattggaggacttattagaagctgggatttttcaccagaggcgaacctatcgaaaggtacgcacgtttgttcttcgacatggcttgtgctttttttttttagtttttctccttcattactactgtgcctatggtgatacgaggatgttcaattgacacttttcgtgattggattgggggaccgaatcatatatagacaagtatcgtaagcagatggtcaagaagcccatccactatagcgcgggacccaagaacaagatccagaacgatatccgatatagcttgatcgaaaccgtgtcgttgaagcgactcgaggctcaggcaaaagaacgacaggagcaactgcgacgacggtacaatgacctcgaggggttgaacatggtcgacatgacggacgaggaggtggtcgagtatgtgatgatgctctcgaaggagcaggaggaacaacacgcagtgcaggaggttttggagatggagcggatacaggaattggagctggagcagcaacgcgccctggaggagctgatcagatcggaacagagtcacggcggcgaagggtattcgggctcgtcttctggtccatcaggttctttgtcctcgtccgcggctacggctacggctacggctacggccactgagagtgctgaggttagtcagcaggagctcgaggaggaggaggaactggtgcgaagggcgattgagaggagtctgatggacatggagacggacggtgacaacttgcacgtccagcatgaggctgattttgagaccatggacgtccatggccatcacggtgcccacgactatcatggtgtccacgactgctcacacgaccacgcaacggagtgggagacgagtcacgttgtggatgtggatacccaggacggtggcgatctcgagaagcgcgaagatcagcggatagtgcagtcgatattgcaggagctgcagcaggcggaggacgcagaggaagcagagataaagctggacaaggggaagagctccatcaaggaggagcaagagccgtggcccagtgtcgcagctgcctcgtcgtcgacaatggctcaggattgtcatagtacaaagcgaacgatcagcgaggagtccaaaccacaacccatgacctggtctatggtcgcgcgaaccaactccgagtcggccctggcacccgtggccgatggacagcgcccgcaggacccgccgcagcggacgcctggcggccgacagcctgcggtcatcaagcagtatgcgcagagcgcctcgcaggaggagattgaggacgatgatacgcagttggcgcggatcctgtcgctctcgatggtagagaaatagggacgggcagtgtggttgcccgtcgtgaggaaagacacgcgatcgtgcgactgcagtaaagtaccagaacatagacgagctcgcgaccctcgacggtcgataccccctcacacgcactgcagcaacccataaaaggagcatgctccgttggtgcctcttgcacagtgtctcaccccgcccacggatatccaagcgacgggtggctggggcgtagtccagcagccaaacccaccaaaacacgcaaatgccgaatcggcggagacagacacacacacagacacacggcaatacactcctgtggcacactcaacacgcctccagcacacacctgcccatctctccttcttcgcctctgaccaccatcgtctctctttgtcctcctttgtccttcctttgtccttcctttgtctccatcctcatcccaccgacccgccctcctttggcagccgatcccgcccttcgcgccagtcgccgacaccctcccaccgcgccgctcatcctcccctcgggccttgctcgccctccgacccaccccctttcccccggtgcctgcctgtgctctccccgtcctctttgtcctcaaagtccggcatcggaagcagatcaactcgagcgtggtggacccttgccaccatcgtctatactgtatgtccagatcccgcttatgctacccaccttgagctactccttgaacccaccagcagaaaaacagatcacaccctaactgtgcttgcccttccctgatccccattccgtagacactagatctccgacctgctgttgctcgggatgcacaagacgacgaggcagatctggacctcgtcctcgtcctctgcgacctcgtgtttcttctgcgacctgcagctccttctgacccagcctagctgcacaaagccaatacccaccgtacgggtgatcggcgcgaggacatggacacggagcaaaagcacccacggcaccaagcggatattgctgcagcaactgctggagcaggaacggagattcgctctttgtcactcgacatcaaccttactccgtcaggcacgaccccagaagcagagcctctgtacatataccaccagggcactcgccagacacgagggaggcgctgtcgtctctactggcagcctgcagcatcaaagcgcgttgccgggatcccagtccactttaccagccctacgcaagacgaggatccccttgaacagcagctccaggatacctcttcagttcaacccacgatttctcaccacgtcaacgtcgacctctgctgcaccggaccttgaagcagacccatcttcgccagcactctcggcggcttcttccatcttgacgatgcgatctgtacacttggcgtcatctcccattctcagcgcaaactctgccatcaaagagacgtcctcgacaaccgactttcagaccctatttccggagattccggtatcgttttcagcttcttctgaaagcagtccatttgcggcagccagatcaggagcaccatggcgtaacggctccatgcatcctggatcggaactggaagagcacctgcggaggtccatctacgaacgggaatcgatcgagacctggttgcctttgtatgaggagcttgcagcaggatggcggtcaccatcacgatcatcacggattctggagactgctctcgtacgaacggattttgttagaattatcaccgcactcaaggtggcgcccgcatcatgcgaagcacgctctcttgcgaccctggagcggatcctggatgactttcaccgtgtaatccagacgcacaagtccaacgtgaaggtgtacgatacctttctggaaactcttcggttttggaagctgaatgatcaagttcctggatgggtcaggcggttaaagttgaaaattatggtcacacccctctcgacgactgccggcagagaacatcttttggggcaaagtgtgcaggaacaataccacgatctgatgagcgtcctatctcacgccaatcaagcagaagagttgctcaagtgtctggaggagctcaagtcaagccggtcaagtctcttgcggccgacgatcagggcctacgataccgtgctggaactgtttatgagaaacaaggaaactgtcgcagccatggggatctttcaggagatgcaaaagcaagggcttgctcctcaactgacaacattcaacattctcatgcgcgggcatctggagaacaaggacactctctcgacacagcgcgtgttcgagagtcttcttttgacggatatccgaccagacatttatacattcaatctgctgatgtcgggctacctcaacatgggcgagatcgagctggtgaatgggttctacaagagcctgggagagtacggactggtcccgaatgctaagacctacaggatcctcatgaagtcccacctgcggcaaggacaggccgatgaggccatcgacctgttttgccaactcaaggagagtacccaggcagatttgcagccgggaacagaagattaccgagttctcatccaggtgttggcaagcgacggcaggatgtctgatgcacttcgagtcctacgtgagatgaccgagacggccaaggtgcctgtgacgacgtcgatttacaacgtcttcttgacacactatgcccgcgagggtcagattgagaaggcgcggaggattttggacaggatcatatctgaaaagctgccgctggtggatggaagcatcaacccactgattcgaacctatctagagcagaaggaccttgaaaaagtgggggagatgaccgaactcatgaaccagtacggagtcttgccttcgaggacgacgttcaacatcatgatcgactcgaccaagagctcaggaaatcttgacggagccatgaagttgtacgagcggatggtggccgagggcgtggagccggacgtatggacgttcaatacccttctggatcttctagttggcaaactcacgccggctcaggataatgtcaaatggaaggccgactcgactgcggtgaccaaggagcagatcgcggaatatgtgcccaggatcgagacgttgctgcaggatatgaaggccaaggggatcaagcctgatgtggtgacctatggcaagcttatacagcagtatgttgtcctgcgagatgtagagcaggccgagatgctgttccatgagatggtcaagtctggaatctcgccgaacgcccacgtcttcaacatgctgatgaacggattcacgcttatcgacgacatggacaaggcagtcgagttgttccgccggatgccaaagtacggggtcgagcctgatgtcgtgacgttcacgacgttaatcaaaggatacgccaacataaagcaactgacaattgctcaggactttgccagcgcgatgcagcagcaagagagttcgtctaggatccgcatggaccagcaaagccttcatacattgatgcagcttgctcaaaagtcacagaatccagggatggcgctcgatttctttgagatgatgcgtggccgtggaatggagcctgataatgtcacgttcacgatcttgatcaatgccctgagtcgcagctttgctgcatccacgggctcaaagtccaagcatggcggcggacgcggccgaggaaggcgaatgactggcgagaatgatgctgttggaggacacggacacctgttagccgaatcgactgtggaggctgttgaatcgattttggccattattgagcaggatggataccctttacaccatgccgagatcacgacgatgatctcggcctacttccggttaggacgacccctggccgcgatcgagtttttcaagaccagtttctggaggcgtcaacccaagctgagcacgaccaactgtggagccttgttcaatggattgttggcgcccgagtatggcagacgttatgatggcatagttctgaatctctacctcaggatgcttgaaaggaccaaggcgatggtccgtgccaaagacgcggaaaaggagtcgcagcagcagcagcagcttaagcagcgcccagcggacccttcaggcgaacaaacacaaaaggagcagccatgctggagttctgcatcatcgacttccaccgcttcgagaccctcgacatcaaaaacagttgcatcgcaaccgtcgaaagcagcctccgagtctgcgcagctacacgagttccctgttttggatctggtcacgatcaacattctgctgcaggcattctcgcggcgcaacaactggaccatcgtgctccagctgtggcgcgatctcgaatcgatcggagccgagaaccttcatccgttcgagatgccactcgagtttttgggctgggcagcacaagcgtaccacttgacgcccgaccgcgaggatgacattctgtattcccctcgagtagccatcaagaatgagaaggacaaggagaggggcattcgcgaaatgtcggttacacaaaaacacacgcgatcggcggccgagacgaatgctgaagtgtctgagaagctactgagacaactgtggaatgcgcatcattggatggggatctcgtggagctacaagatccatgggcgcaacatctttgggtcgtttatgcccacgacggctcctgctgccacgccttctggttcgtcaacagcctcgtctgcaggacctcccggcgggacccactcgagctcgctactatcgtcgttcctgtctgaagatggttctactcggccaaactaccgaggaggaccaacgaccagtgcatatcctgagggcgagggcaagaaggaggatgaggagcgccagcatcatcaacatcattcatagaaccagcggccccctcctgttttcgaaatagatccagctccatttgcatcaaaatatacggccacgctttgcatagtcttgttactcggcctgacagattccgaacggttgatgagatttgtgacacacagcccttgccaaatactaaatgttccttccaccctcctctcacaggaacaaaaaagcaatacgtgcctgaacggtggacaggatcatgcctgattgcgtttattatttgttcacaatcgatctgtctccagtgtctccagtgctttgacggctgcataagttgttcactgtcagatggtcgttgtggttcgtttatcgtaactttttttattttttattttgttcctgtgtcgctggtttattgccttgtagcccttattgttgtagtgtcgctgttgaagcagggttcttttttttcgattgatcgaaacgcatccccttcctaattccctacttggctcccttttataaaatccattttgcccaaagagagatttccacctctcccaaaaaaaatccttcaatccttccatcctccgttggtaatccactgaggagatgtttttttttctttatcaatccgactttggctgcgagtcctcgttgaggctggttgggatttccgactcgtggacgagtgaactttccttgacgggtggcgatccatggatcgggttgggtgcctgtgggtttgagtgaggaatgttctctggttgagggtgttgcgatcctactggtgctgaagtttttcctgcctttgaaagcgcgtaatctccagagtcaaagtatttgcgttcctacgagattattgcaaaaacacatagaccatgatgcgttaatgaatatagaccatatattattattcgaaataaccagccaaagggtgagcctggcctatcgattaaaagaacgccacaaaaagcgctttgcagatctgacgtcgcatggggtgcgccatggccgataggggacatcttcctcgcagggagtgttcctttttttcttttgttcttttttttttctctctctctttctttttttttttttttctgttgcatgtgggctgttcataccttcaacttgtggcccaagagatctcttcctgtaggcagcttgccatacatcctttgcagcttttgctcctgctcgctcatggtcttttttgggtcgattttttcatggcagacggagacaatatagtcgaggaggagtcagaggggtccgtggtatataacaagaagacaggagagaaagtggtcaaacgagtcaattatgaagtcattcttcacttgcaaaaaggcgaaccacctttttctcaattctttttttttcaacatccggctgcgggcaattaatagtgtctcttgggttcgatgtcagaaaaaacaaaaaaaggtccatcaatgcagcagtttaaacagaaaataatgtaaaaaacaaagtccttttgaaggtcgcattgccatacctgggcctcagcgcccgtcttgcttgctgggttcaaaggtgagctcatggtgcaggcgtgtgagaaaataaggacggtgtgcagaagaaaaagagtcgcgagaggaaaggaccttctgcgagaagaaggggaggaagtgaaggaagagagagagagagagacagagagacagtcagtgaaaaagcgcgcgtgtaggtggatgaaggaaggaaaagagggatcgcgtggagaaggatgaagtgcaaaggacaagaaccaaaagagaaaaagaaatctcgcttcttgcatgctgatcacccttctcgtcgagaggcgcatcgacgtcattcaatcctgaagtgggaaaagtgactttcaatttcctttccggcctgccgtgcctcccactagacgcgatcatgggtcaagcgagcgccgtgtttggtcctggctctcgttcccgttgcagttgccttccttaaaatatatacagcaggtaaggcagggatgagaagcgctttgttaaagggctgtcgcgacgagaacgctaccctcacatagacaacgtctctgtatgcacaagaacgcagcctcggagaggagccctggccttcgcctttcatctcgcaagttcctgcagctggactagccaaagtgaaaataggttataggttggaacgagcgagagcgagcagaggaaagactgagatgaaagagcaaaaagatcagcacatcattcgggctgctcagagttcattaatagcattttccctctcttgagccatgcacatacgcgcgacctacccctgtctagggattcatttattactccagacacggacacaaaaaaaggatcggttaatatctctccacgaaggctgaccgatcgaaaagtctactgctgctcttaacacgacctagccgtcgactcgctgctgtgagcatggctggataaccgcatccaactgctgccgtgctaacgtgccgcgaaagatgtagcaactagcaagatgcaatatgtttttttatttgtcgtctggcccttttccaccttgccccaccgcttacctaactggactacgttatcatttcagcttctgccgaggagtagctcaacggctggtgctggtgatttctggacatgtacttgacgaggatgcagtgtgagtttgccggtggttagatcattcgttgcacaaggagagcgcaacgtagtgtatacttggggaaatacatacgttttcgcacacccgcaaatcacccctgtcattgccagcatatgtgcctgtcgtcggtccattcactttgcgcgacacatggactataaagacgtggcactgcaggcgacgtttgaaagaaccaatggcgaatgctgcttagattcggaatatagcaacgacgaccaatactgtcttcaaacggacgcaggggaatcaggaacaggtgcaggtagcgtgtcagaatgcgcgagatccgcccgcagggagaggaaacgaaccagggttgcctttttttttttttttgtgcatcgccttcttagtttggaaggttctctcaagagcaataaccacatcagcagcctcggaataacaacggcgacattttcaagagaacaagatggacaggagcagagtaggccaagggagcgagcgagagagggcgagagagcaattgagaaatagagtatattaaaaagcaaggacccttggccctattttttctcctcgactctctcgcacccgctctcttcttttctcgtccgtcctcttcctcgtcctcgtcctcttcctcatcttcgccttcttcttctttcctcattcctcattcctctttcgtcctccactctctctcttctcattttgttggcgctcactctccattctctctgccacgcacgaaggcacacccgatctcgtcttctcagccccactttcttttctctccccgacctgcaaacgagttcgaacagacgcctcagacgacctcaatcggtctcactcacaccaacgcgccccgaaaagcagccctgatcctcaaactctcgcctcaaccgcctgctcatccttcgtccgtcctattcgccctccccgtcccttacacactcgatccgccaacataccacatacaatggagctctcgcccgtaccaggaactagagatgcaagacaacggtcaaactcgacaaactccccctccgtacaacaccactaccccccaagccggacagatcacaagaaggccaaggccattagcgatgcaattgataaatccttgaaaactgacaaggagcgtctgcaaagggaaactgggatcaagctcctcatccttggtaagttgtggtcctcggggctattaggcagtttagccttgtcctcgaccacccgcctattactcggcgttacaatgctgcagcgagtcttccctctgtcatatgatcccctatcccatcggtctatccacccctctcgcatctccctcccgggcctgccaatctataccactcgttcccagctctccctattacctcagcttgcgtgcatcctgcctggccctgcaatcaacgtggtttttttactttatttttttgctccgagcaaatacgagcctgcatgcatgaatacgcaattgaagtcatagccacacctgcatccgttcgtcgagtgacgatgcagtgcatggatttagagcatgtacagggcagaggtagaaaagaccagcaggagggatgagctcttcccgttttctcggatgagcggggattgaccattgaattgaattattattttgcgctaataacagtagcatgtataaaaaaaagcacgttgtcaaggctgcagtgtaatgtatctcgctttgtctaaccaattttctaattttccctccacgacaaccgtccaaataggcccagccgagacgggcaagacaacggtactcaagcagctgaagctgctgtacggccgcaagggcttggacgctgagcgcgagacgtatcggaggattgtccatttaaatgtgatgaaggccatccaagccttgatcgagggtcttgaggaggccaacatcccattggaggatcccgccaacatcccgcacctggacacggtagcccaccacctcgagtcggccctgaaaaagtattccgtcacatccatccacggctttaccaacccagcgatcccccgaaaaatcaccgacgccaaggcagagaccgatatgtttgcagagatggcgccagccatcaaggcgctgtgggcggacggcagcatccaaaagatctttcacacttgcacgcagctcaatattcaagactctgcgaaatagtacgactgcgaaaaacagggttgtttggccatcttgcctcatgtttgatataatgttatctaacaaacttttttttttcctggcatcgtgctctttttgctcaatgatcggttctagctttctggacacggtggatcgtatctctcacccagaatacattccctcagacgatgacattttacaggccagagttaagacactggctgtgacggaacacgtgtttcacatcgagaacgtggcatacaggtacgcagtacgcaagcgagtgatcacttcaacggccttgtgcgcttgttgcccgtttcaaaatccatttgtttgatcggatacaagtgcatgccgctcgtcgcgtggatgaccttgaatgacccgctgcagtcagtctcacgaactttgtttgaagcggccccttctgataccttcccctcccgtctctctattttacgtgcttaggatatacgatgtgggcggtcaaaagtccctgaggaagtactgggcgtaagttgctgctaaaacaaaaataatggttcatcaacggttgctggtacttttgagctgtacactcgggtcttttgctaaagaatgcaggctgcgcaacctgacagctgctatacatgtagtggcattccctcggcacgaaaaacattacatttcgtttgtacaccttgggaagggcggcccattttttttttttttttttggtcgagattcgtgtggtgcaggtttcagtcgagatcgcatcagctccacttccccctccagagcagggctctcatcgttttttattctaactgtcatttctcgcgttcaaacatttggttgcttccatttttctcctttagaccgtactttgatgacgtaaatgcggttatcttcatggcagcgctgtcagcttacgatcagccgtgtgaagatgatgcaaggctcaaccgtcttcaggagtgcttagtgctgtttaaccagatcgccaaccacaagttgtttgagctcacgtccatgatcctgttcctgaacaagatcgacatctttcagcggaaactggattcggggtcactggtcagcagatactttccagatttccatggacctaatgactatctcagcacgaccgtgtttttccaataccgcttcatgcagcagtgcaaggatttgcaaaagcaggtctacacgcatttcacccatgctactgtaagtgccctcgtcctgtgttgactctttgcgactagcttttgggacaaactgtgggtgtgcggttctatttttttttttttttttggttggagcttcaaatcaacgggcggagccaaaccctgttcctcgcctgcatatgcatgacatgtgctgccacatggtttgtcctaccttcctttccaagtgttcccagctgcaattggacgatctcttgtccgagggccttttttttcaacattttttactacccaagtgcagctgccgccgtagggatgccaatccttacctgtgtcactaacagccacccacttacctttttctcaatgccttgttcggcacatataggataccaaccagatgcgagtgattgtagtggctgtgaacaccattgtccagcgcttgaatctccgcaactccgggctcatttagacgaaaacgagaaaaaaaaaataggcctgagggacaaaaaaaaccttcatcgtctggttttatcttccttttttcaacccatctcgcctttctttttttttcgtttcgaaccttttcttctcatcctctccccggttgccgggagctatttttttttttctgttcgatcgttcaaacccagtatggcgtagggtttgttccaatcatcgcgtcgtacacgaatcgcgttgaagcaaagaaaaatgaggaacgagaacattttttggccgtaggtgtgatttcatccaacttttaacaacacacttcagcacctattctttctttttttccttttcactatatccttcacaacaatttcgttcgatattatttgcattttttgttggttgtatcatatcatactttgcacttatttttttatcaatgcccttatagatctcctcagttttgcaaccataaacatcattcttcaacataaggaggaaaaaaccagaaccaagttcataatgtcataaaaccgtttttttttttttttgtacatatgagtgtcagagaaaataagagatctatctacggtttcgttcatcaacagcctgcatcaccaccttcacatgggaatacagcgtggcatcatccatggcacggagatcatccgggtgcacctgctggtctcgaccatggctaatgttctgtagccgggtccggctcccctgatgaacaggcgtcagcgtcgtaagactatgcggctcgaactgttgctgctgttgttgagatggcgacgactggctgtgggtcgggcgtggcgagggtgtgttggggtgcgggtaccgtggttgacggtatcgtgaaggggagtacgatcgcgtggtcatgtcatgtcgaggggtggatggatcgtcgctatcagagacatagccctgtcctcctcctcctccccctccatttccgcctccacctccattgctaccgatagcgctgccatgaccgctaccagcgttgctgccccgcccaccagcaccccttcctcctctgcgtccgccatccgagccttggtaactggccgatccttggtagctggccttggacccatggcgaccatcgtccgagtgcgcagcagccgcagcagcagccacagcagcgcgtcgagatggaggaggcgtaggagtggaacgcgacatgtgcataggcggaggcgccatctcgtacacgggcgaggacgatcgtcggttgtagtcatccggcgagtgtgctcgtctgtggtactcttccgaggggacgcgtcggtcgtacccatcgtcgtggtcgtggtcatggtcgtacggatcgggcgagggggatctggcactgtacgtgtccaagatcggtggtgagatgcgcggactccgcttgggatgatgcgccatgcgttcgcgaaggtaatcttcatccatgggttgacccccgcgctcatccgcatgatgcttgtgctcgatatcagcgtaaaattcctccttggtgagctccttgggtttcttggtgcggtagcgacggtagccgaggatggcgatgatggcgaggacgacgaccgcggcagcaaacccgccgatcatgtaaacgttgttggaagtgtcggacgagtccttgttggatttggagggcagggacgaggccgaggaggcgggggaggtggttccggtcccgccgtctgtgccgcctgtggaggagcccggtgaagcggagggcgtgggcgatggcggtggggggggaggtgggggcagagtgaattggttggtccatgcgttggtttttatgttgtagatgatcatttgctgcgaattggggtttccactcttgtcggcacctataaacaattggtatgtcagctatcatccttggtacaacctgccatcacttgacacggtcagtttgtcgttcttacctccccagacaacaaagttgtctcctgcagcagcacaggccatcccgctccgggactgtcctgcagcggcagtagctcccgttgtccacttcatcgttttgacatcgagaatgtaaacagttcccagtttaccaccactggctaaatttgcgtcgccaccgaacgcgatcatcttggttccattgtaagctatgaagacgacgatacctaggtcagtggtatgctcatgcaatgcatgatcagacagccttaacaatctgtcactcaccagaaaccatgcaagcgtccagtagaccctctttgcgcggtacgttcgtctaggtgacattgaaattgaacaagcacgatcagcaccataagtttttttcaaggataatgaactctaggctgaagagcacacttacagttgaagtccaggttttagtcttaggactgaactcgaacagatacggtgacaccacaccctccttccaacctccaaccaaaagtaaagtcccccgaacagtagaccaagcagcagcatagcgagtaattgtcccattcaggtctttcctgatttctggcataggtgccggaccggcactatcgctcatctcggcccaagttagcattctgttcccgttagatgccccagatagggcgtacagcatccctgtgtcggggtccgctactgtcacaactttgtcctcacccgagctcgtgcctaccggtaaactgcgagagggctgccatgcatcggttgccatggtgtaagggtagatattttgtgaattccatacgagcaaattctgcttatcggccgagagggtcatggaggggcagagggacgtgggagacgagtttgcaccagtgcctagactgagggctttccatggtggactggaggcattgaagttcaacactgtgaggtcgagggcgtagaattggttggaagggttggtgcctgacgcgcctccttgcacgtagagagtcttttcgtcaacagtggtataagcaggacattgtacaggaatagggttttgtgcgaaaacttgtagggtgacagacgttgaaaggaggagagcgacggcggtcctgaatagagaacgggtaggagtactgttgttctttggtgatgaggccgatgctgtgtatgggttgtgctgtgagcgtccaaggctggtgggtgccatctgggcaagaaggtgccgtattaggggaagagaatcgtgagggaagtggacgtgcatgctggagatgagtgatgatgatgatcgaacaagagaacgacgcaggacgaggagagggtgagagtgagcgtgtaagcgagtcctggaaggagcaacgaggacaggagagtaatcagaggtagcgggagaaaaagaacgagagaagaaagaagagaagggggtgatgggacgatgggatgctgatgcacactcgagtcacagagagagagagagagagaggagcaattgtgcaggactgacgcgtttcgagtgaagtgccctgggacagtctgaataccacgcattctcccattcctcccacccggcccctgcagtacatgtacctttgctctgtctgccttgctggcattctggtaaggagctgtttaagagttacagagtagcgcatcgaatatgattgcgttacacacagagcacatgcagggtaggggatatatttttattctcagctggcaagtctgctggctcggcaacatataccttattgtcatttttcactgaaacgcttttcctcctaggaaaccttcactttgttttgtacttcccttcatgttttgttttactgctcttgacagcgtgtcatccccttgtgttcagggacggggaatgctatattgatgaaagagtttcgacgtttgtgcgatatccaatccagatggtatagctgttcaggaacagatcttatagtgcaccccgagcaattgaacggttcccttgcgcggcactggatacgacacatgtacctcaaaaggtccagtcaacgtctcaggaaccgaagcgggtcctgcgcttgccagggggacgagctgagacgtgactcgcacggttctctcctgtctgaatttttttttccccacttccagagcagcgagcagaacatgctttcgatcgagaagggggtgattatgccacgctctctgaaatcatcgctcttcccttctaagagccttcgcacgcgcattatttgaattttttttttccctctgcactttcaaaaggctgtgatcgagctgccatggctttcagaggccgagaatggccgttttttatttcaaatattttttcacatccaagagatgcattaccatgccaatcgtccacttaacaaccaaagagcctttgaaatgccgtgtattattatgaaatctagtagattcttttagtcttttcttttatcattgctgttgatgcattcggccttgaagacggtgtagctgagctttcatacgaaagatttgctctgtcagctctggatcgcttggaccattaaaatcattataggcgcgcgggattcgtgctcgctgccggtgttgtgctggaggggggaggggatagtttcttgggctggcgctgctgtaatccgactcaaagttggaatcaggccattgtccatgcatgggccgcggcttggctcggcctggatgatgttgttgatacgcgcgttgtcgatacgcatactgtgaggggtgtactgaactcggactggaggcatagccgaccatgcctggatgctgctgttgcggccgccagtatgacccaggaggtcgccccgttcgggtggatggggcgtcgctgtcggaccccactcctctgcggtcaccttcggaatggtagcccttgagtcggtagcgatcattgggagagccatgtcggattaatggcgttgtggctcttgaggatgggttgggcgatgtgaatcgagagggtgatgcagatcttacagagccgatctgcggtggtgagacgtagcttggatggttggccaaggcataatttgaagaaccaagcgtcccgtcgccttgaggagctgaaccactgcgagagtgcgttagatccaagctcatagagtttttgtctgactgtttgtcgagtcctgaaagtctctcggacttttctggagctggccgttgtcgttgaaaccgacgacggaagcggctgtagataaggcatccaatgaacaagaagaaaagaacaccaccggccgctcctcctcctatggttgcagctttgacatcaatcccggattttggcgttgctgtgggtgtgggagtctccgtcgtggttggtttgggtggggggatgtaattggtgatgttgggaggtgcgacgggcagtacgaattcctttgtccacacgttgaacagcatgttgaaaatgaccatgtcatccttcacgggttggtcgttcgcatctatccctgtgattcaaacgcgtaggtatcagttaataactcagtacgcaaagaacgtctgtaccacagcgatgttgcaaatcaaaacgaataggtgttgcaagcgtacctccccagatgacaaggttgtctcccgctacaacacaagccatgtgagagcgatgctgtgatgggtcagcatctggacctttcgaccacttcatctcaaggacatccagaaagaatatgcttcctctcactccagctttggtgcgaccgccaaacaccaccatctttgtccctttgtaagctgtaagattgagcgtggtaaaatgttagtttaggcattataaaagggaaagaacaaatgatgccatgaatgcttaccaggtaccatgcaatggtcagtaacttcaccaggagttactcctgactgtattttctaaaagaccgcataataagatgacccaacaagaagatgagataatgagccatgggaatcaggcggaaagcccctggactgatcagcgcatagcaacgggctacataccggaggaatcttccattcttcagcgtaagccttagtaagatctgctgtgaaacgctcgtactccattacgttcgtattgtagatcgatctgtccggagtagtgcctccgtaggtcagaatgcgagaccttaaagtcgaccaagcgagtgcatacccttgagtgacaaagagcgaaccggttccaacattcccgaccaccatagggctcttgagcgggagagaggtgttgtcgaatggttgataggacatcataaatctcctggagaagcttccgcaaagaacatcgaggtgatgatgtgcagcgtcaaagactgcgcgagcctccccgggcagtgtgtcattctcggtcggttgatagatgcgcgcggcttctggcagtggggtttgcgtccacgcattggtcgcgtatttgtaagtaccaacgatgtaatctggatccgctgaccaaaaatacacggcctttgatactgcagacacggccatggtgtgacctttcattcttataggtcctccacccttgccctttagtgatttccatggtggattatcagtcgtccaccggcgcttggtgaggtcgagagcgaaaaactgatcggaggccgagccgtcgactaattcgccaccttggacgtacaacgtcctttcttcaagagaggcgtaggcaaatcttttgagggcggcatctggtttggactgagctagagcctggaaggagagcgtggatacgaggagaacagcgatggtgaatctcgagaggatgaggaggtttgagggatggtgctttgagtgccttccagctaggctgtgtgttggaggagagtgtgtgaaaaggcccatctgggagactgagtggacaaaggacggagtatggtgattgttctcaactgcaagacagtgaggcacgaaattaagagagggcagggcggagggaggggggaccgacaaaaaaaaatcgaagaaaaaaaatagataaagagaaagagtagagaggaaagagacaacgagagaaaaataaaaaaggtgagaggactgagtgtggactgagggacgcgcgagaccaaacgctatgttgatggaacctacgcgaggcgagggggaatgttttcgttattcaggtcctttgcgttttgtttcactccatgtcgacacagcagtgcaggaaatcaggggcagccaatagtttgagattcacaagtggcctcaccttgcacagacgtccatgcaccttttgctgccaacactactgtcttgttattcactggcatgcctcattcgggtccaggtgcatgtatcccgcacatacgatcctttattatacaacgcacgcgccgttgtgaaaacagctacacactggcatcacaacataaaaaaaatgagagtagtaaaaatagacgcacttcgtactgccgttcgtcgctttggccatgttccctggacccgtccttcagttcttgccaggccccttcactctttttctatcacaattggatttttattaaaagggttcctttcctctcttacgtttttatcaccaccttccaactctagcggtgggtcggctctgtgaacggatagacgtgaccattggttgtcgattttgagtaatggtcaagtcagcagtgacgtccattaaagaagtcccgcatgctgctgccgctcctgaaccttttttttcttttgcattttttgtattttgccctttgttgaaagatagctgcttgtcaatgatccaaccgatggcccacccgttataacacgatctgtattcatagtgagacggcgcacgctcctttgggttctagcctctcaagcccgcgcaacttttctcatgctcttaggtatgtagcagacacaaaggttacccatgcaaagacgacatgctctacactctgtagttttctggtgcagttgaaatagtgtgtgagtctccgacattgccagggcatatgcggacgatgtggtaagaaacccctccacgtgtacctgacatcgaggccccttctagtcagagttgtcgatcaatatttgcgctcgctttaatgcgcgacatgactagccgcgtgaagcgcaagcgccgagccttgaacgtacctttcagaggtgatattctctgatagcccctcgtaagacaaccgtgtgttagcttttctatgcagctggcgataaccttgcacgatggtagacgcgttgcactgctgctgttttgctgcctgtgccatcataatagtcggttgttgagatgaacattgatcgaggtgatccttcacccaacactacaaaagcctttttctcatcagtcttttttctttaagctgcttcaactctcaacacatccgtcatgaatctaatacacatgagaatcctctagccataagcaaattctttacatgaacgacacgcgtcaacattcaaccatatctctgtactatgttaaggttataggcttgtacgcactttacttgcatgaccaggacctggctacgtgagcttgaaaatttcacgcctggtacctatctagctccaatattgtgccatctgcgggaccctcctgtactcgtccgaggtcaggttcttggcagtgcccaaccatcagtacgcggccatgcgcccgttctatggctccttactggccgcatggaccttgaccgaactcatctacaccggacaagtaggctcggtcatccgaacttccactcgatccgcaccgggaggctttatgcatcgtgtacagatcctggcatgggacaagtagtaccgcgcgaaggtcagttaaaggaaatgggtacgcgcattcgatatgcccagcgatcggggccgatgtgcttatatattccattcaccgctgatttagctgaagcccgactccatcgtctgtttgatacgacgcgggtgctgctctctctctagccattgtctagccatgatggagcagggaggagcaaagcataaatgcactcagcacattatgtgcgcgtgggtgggtgccgtcgacagtcagggagttgtggtacgagcccccggctttaccgacctacatgaggctctaggggttctcggctgagaccccttgcaagtgggggtagttcgagggcacacaacatacgctccagcaaactcgcacctgcttagaagcagagataaggaactgcttcgtggtatgaaaagacatatccttgtgcatagggtagggcaacggcataagcaagtcaaggatgagggcctggttgagcgggcagcctagcatgccgtattttgaccacgggacaagatgtatgcacttgtcatcggccaaaatggtattgtcaaaaagccatcgaccaggactatttactgaagtacatgttcgatgaggacagcgaggtgtcgttgatcaaggaaggcagcctcaggagtttcgaaagcgacgaactcctcgataactcccggcaacaatggcaagagtagctcctccgattctattgtactcggtttttttattttactatcacccttttcttagcatgacaaggaccagtgcgtgaatcagcaccgttggtttttgcctattttttgagaggcgagctggagtcaaggaaagaccctttaatatagggcttgcaggcaacacatcagcgtcgaccgagccaagactattcaacatcgagaccagcgatcgttcatgcctttagcaaacaacatgcaaccacccacaagtaggagccacacatcttcataggtaataaacctattttcttttgactgttgttacaaatagagaagctgacctcgttgatgatgtcgcgtgccaggtagcggggaggagagtgtcgactattttggtgctgtgcgtgtgagaagacaagggcagacgcagggggacagactgatggcgctgctcgaggaaaggcggcgtggacagatggaagcgctgaaggagcggcgatgctgctagaggcgagaggttatgccgagaagaacggaggcgttgttggaggtaaagaggtagccatgatgggactggaagaggacgagagttgttcagtgtggagtgggtcgagagcggaatgcgatctgtggaaaagggctcgcacagcgagtgtcactgatgcatggcgaagacaagggcgacgaaatcaaagcgcatggccgtgttatacggtgtgcaaatccttctccaacttttttttttttggcccagctccttgctccttcaacatggaggaaataagggtggaagtaaacttaaaacacatacatgtttgtatggaattaagacaaatcggggaattaagtacatgacgtaacagaaacgtgcgcagatacttggactgggtggcgcagcgagcgaacacaacttgttcgaggtctgccgcctcaatagcgtaggggttatcgcgtttgtcttgtaaacaagaggtccctggttcaaatccgggttgaggcacaagatcattctttttgcacttttcccgttcgaaatgccgcgggagcactagcagagtcatcagcgacgattctggtgtctctttttttccattttgaaagaagagaggcactcagcacgcattataacaaagaaaagctagacaaacgtttttcgcggcggaatgggcacaggatcagaattagtaaagatggcgattttgcccttcagtctttgtgtatctcccttagtgagatagagccctaaatcgtgcacgagttcaggacactgcctcggcggtgcagcttgttactaaaagagtgttggcagtacaaaagcccactgcgggagcgatgtcgcccaagcctagacaggctgtgcgctgttgtgccgtgccatagccacatctcgcacatataattagatttttccgatgtactgtacctccctatttctgtaccttctcgataaacattcaacatcccttcgtctcggatcgatagggagctcacatcctcagggcagcgtggggctgcaaacgcttatgtttgtgcttatttttaaacacgttaacctttcgagaagactgggcctgcgcctggctggcaaatcataggagccgcgatcctgcgatcttgcaccaatcctcggtaacagcaaaaccataaataccctgctctactgaggtcacaaagtcatccccaaagcacctttctcttctcgtctcgacttccttgatacccttagcatctccactctcgcacatagcactgttattccttgcactccacttacagcttacagccagctgaaaatgatcaaggtatcctcgctcactattcttctccttggtctggcagtcatcgccgcccagaaccttacgggctacccaccacgcgacgagattccagatgtcaactcacctcaggtccaagcatggctaaaggtacacctgccgttgttaaaagcgagccgttttccacgatgttcagtcagtgctcatagacaaaggatccatccattcgtatcgtataggaaatcgacctcactggtgctcctgccattgccccctacccaccaggagaccccacaccagcctgtccaacggctgccatcaacgcaaatgagtatgtggttacaacccacattttgaattcaaatctttcattttggggagtttttttttttaattcaaacaaaccacatttatttcgctctattcagctgcattggaggatgccaatcatgcaagggcgacgatctggttgaatgcactgcccccaatacgtggggcgtcacctttgacgacgggccagcaccatctacccctgcgctgctcgactacctccgagcacaaaagatctctgcttcgttctttgtaatgggatcgaatgtcatcatgtaccctgaaatcctcaagcgcgaggttgccgaaggtcaccacctggcctcccatacttggtcccatcacgccctgaccaccctgacgaacgcgcagattgtggccgagatgaagtggacagagaaggctgtcatggacattacagggcaccgtctcagatatatgcgcccaccctatggagagattaataaccgcgtccgcttcgtgctcaagaagatgggctacgtcgttgtggactggaccggcgatgagttcgatacgctggactggcaacccatcccagagtcagaaaaaattgcccgtttcacgcgctcgctggatgtctatgctgcctcgcccaggaccaaaggcttctactgcttggagcacgacatcacccccgcgggagtgtccttggcccaaaagttggtgcctttgggaattgcccgtaatatcagctttgcctcggtcgctggttgtgaggctggtgccgctgcttatcaaaactcgaatgcgaccccctcggcgtctcttcctggcacagcaacggccaccgccggcactggaccttcccgatctcagtctgcctctggaggatccgtcaccagcagcgtgacggccaaggttgcgggtgctgcctcgcacaccggcgaagttgctctcagtgtcgcatccgtgtttgttgcattggtggccagcattgtgcttgcctaagtagtcctcagtcgacactattatttattcctatatccctgtatctatagccctgtagaaagcccagtaaagcgcttgcgacatgtagtccgcttcaaaactttaagcgataacctttgggtgcaatgtcagaccgccactccttggccttttcaaacccattcttgaactgtctgaaatcctctagcgtttgcttgacctcatccttggagttcatcacaaacaaacggtcctggacaatgggctcccgaagaggttgaccggccagaacgacaaagtgggcttcctcgtcggtggtttggattcggataatgtcctcgtctgcatcctcgccctgagagagaatcagtgcttcgtgggcacgtccttcaaatggccgagaaagatcctcgttcgacttggctcggttcctggtttcatcaagtgcttctcttggacgcgctgatggttcagtcgaggcaactccgtctccaaagtgcgccttgccagatagcatgtagacaaagcccgcatagtcctttgggatccgctgttcgatagtctggtgtggcttcatcttgtagtccaggtagatggctggcgtcctcgtatggacctcactcttggcaccatgagcttcaccagcaataaccttgactgtcactccttcctttggatgtgctctcgggatctggtggtcgcgtcgatcctgatattgtgggtcgcaggtcttgtcctcgtgcgaaagattgacccaaagctgaagaccgtgtgtggtgagagtgtccttggctcctgtatcagcgctggccccgtcgtctgcgtccttgactggcatttcgcaatgaacgatcccacggcctgcggtcatccactgcagatctccgggcccgatctttcctttatgtcctgcaaagtcctcgtgctggatgtgtccgctaagcaagtaggtcaccgtttcgaatcctcgatgggggtggtctggaaatccgccgttgggtccgacccagaactcgtcgaggaggaggaaggggtcgtgatggtgcatctggatggtgcccagactgcgacgtacgacggcacccatgccttcgggtctctctgctgcatagatggacttgaggatatggcggccagcagccacagaggaagaggccgagaagcgggatatgcgcgagggtatcattcttgagggtaaaagtaaagtcggtcttttgggtgagagagaggaaagcagatttcggagaaagttcaacgacccgttttatgcgaacacggccagcttcaccctcagccacaatgcttagtgagcccttgcctttcgtgacaaatccgggccgcaggtgagaaggaagagtgcaagaggagtgcaagagtgcaggaactgtgaagggtctgaaaggtgtcaagggcgggaggtttgcgagacgcgcgagaggtaaacaggatgtggaaggaaaacgaaagaacgaccacgttgagccagcgcctcccctagggtaagtgacgtgcatggatcgctggcaaaatggcaaaagagtatcaggacacacacacacacaccctgcaccacacaccttggctgctctcgctcccattcgcattttctcccacacaccacgcctgcacatacacacgccagcacatgtcatccgacgaggacatccccttccacaagcagcccaagtgggccgacgtcgtgcccatcccccaggacgacggtcccaacccactggtccccatcgcctacaccaaggaatgtacgttccgtcgtcaaacttcatgcaggcgtattctcgagcctctggtctggtctggtctccgttctgttctagttatttaacccaacgcactcctcctttgctgtagactcgacggccatggactacttcagggccatctgcaggtcgcaagagcagagcgaacgcgcattcgagctaacgacaattgtgatcaatcttagtccgtctcactacacagtctggtaagtgtttccagtcaaacgcgaaccaacgcgaacaacgaatgcaaaggaaactcttgatgcttacttgtagcactgtgcttttacgtaggcactaccgccagacgctgctcaaggccctgaacaaggatatgacccaggagctggagtgggttcaggagatgattgacgagcacccaaagtcctatcagatctggcaccatcgccaggtggtcgtcgatcacatgtcggcctccgcgttccctgccgccaccctctccaccacaccatccaacttgcacactgtccccatgataccgtacctggagttgtccgagtcccagcaaaaggccgctcaggaggcggttcagaccgagttgaactgcattgcacaggcgttggtggaggagcccaagaactatcacgcatggtcttaccgccagtgggttctgagccactttgggcaggggccatggtgggaagaggagttgggctatatcgacgagttgatcgctgtggatgtccggaacaactcggcatggaatcagcggtactttgtagtcacgctcggacccaagggcttgacggaagaagtcctcgagcgcgaagtccagtatgcaaagacaaagattgaacggacgcccaacaacgaaagtccatgggtgtacttgaccgggtaagagatccatctcccccatttgaaaagtggtattttcatttccattttcatgtctctaacttgcacgctactgggattgtggtgtctttattgtcgcggagtatagagttttgagaaaggctggccacccactgtcagaaatcaagggattctgcgagggtctgcttcagaagcccaatgccaacttttcgccctttgtacactcgacgctgctggacatttacgaacaggaagccaagcaggaaaggagggctgatagcttgctgaaggccaaggaggaggccatcattttggctgagaaagtagataccatcagggaacgatactggaactggagaaagaaccagctgaaagccatctcactggaagcatagtgatttttttgttatcctagtccaaagattgtcagaggatgggcgctcttggatgttctaataaatggcttacaagagacagataaaggcagcactctgagcattcgtttaagcctttcgcagtgctcgaggaaggtggacagagcatcaggcaaatagtagtcgccaccttacaaacgggacacgggtctttgtttgacaagtcgttgaacttaaggttgcagtttattgaactagagtgcgatgaagtgattctctgtatgcaaacgtaactgctgagcaacgatgctcctaaagaagccatgttgctaagcaaaaggacgctgtcaaatgtcaactacggatatgtgcaatatgtgtactagatgacccctatgctgaaggaatgcaaaactgaacgatggaggggaggacatgttcttctggtcgcgcgccggaaagattatccgacagtattcaaacgataaagtgtgcgagtccaaaaagagtgtgggtagccccacgagagagcatagggcacgcttgtgttacctagtactggatgcaactaaagtcgacctcgaactcgcccacgacgggatcgatctcgggtagctcaacgcgtttcaggaagtaggccggtggaggcgtctgaggtgagtctacgggtgaaaggaattgcgggttctggtagtaagggctaccgttgttgacacccgtgtggttgttggaattggcgcggtataaaccaggattgacagtaaggggcatcctcggctgttgtgattgtggtgtttgtggctgctgctgtggttgatgttgtggttgctgctgttgctgcctgtgtggagcttgcctattgttctgagttgcggtcgagatgcggggttgcttgtacgactgctggttgaagcggggctgttgggatgcgggttcttgaaaagtgacatgatggcgctgctgtctggacggagtggacggttggtgttggggctcgtgaggtgccaggtacgcgccatgatcatcatagcgaggagacacggagacattcttgtcatcgcttactatggccaagtggtggggtttgccttgctgcttcctcaggaagtgactccgtctccagcggtatctctagattgcacaaccgggaaaaagggagaaaagtatcagtgagggatgtacaaagcaggcctcgatatttcaaaaaaaaaaatcaaggaggggaattagaaaagcacgcagccatcaactaaagatgccggaaaagcacaaggggaagcgagggggcttgctgaaagtacacgaatggaaagataaaagatggacaacaagagggagggacgactccggtctaggtgtgcatgagtgaatctccgtgtgatgtctgctacacctgtaactgagaaaacaccaggagggcaacaaagagttgtccctggcagtggatatcgtaacgagccgaattcaccccctcaacctgtccgtcccaccaccacatctcattttcttttgagcttgccgtcctaaactctccccctggtaagacaccatgaagtgatcaagagcaccccgccgagtggatgcaaggggcgacaggaatgctcaactctaggcacggacaaatgaatgatggctacttactccgaactgcaatgacagcatgatcaacgcgaccatgggcatcacaatggccaattccacaaagacctgcattgtcagcgcccaggctacagatccaagggtaacgcagctgaacggcagaaaaatccagaggaacttggactggcgggtatcgtgccaaaatccaggaaacgtttctggggtcatccttgtcgtgtgagaagttgagaaagactcgaccaaggacgtagcagccgagatttccggggaaagggcgtcgtgagggacgtgcggggcactgcacatgctcggctgactgccgtcaaacaagcgactggctcttcgaggacttggagacgcagcaactggtagctcatcgcattgaataggaatggcttgaggaggcagcattttggccatctttggacgcgtcacggccgctgtcgttgctccagtggcatctgacagtttcatcattgatggccactgcactgagggttgttgcttcttggtgtcgaagccatagggcttactgtcgccatgctgctcagggccagaggagtggagatagggtggtgggggagagacgagtggcgatgttgggctgttcaagctgagatcctcgttcataatacccgccatttttttgctgggaatagtaatgaggcgaatggatttgctgctaatcgtgtagctgctatacttgttgatggaggtctgttgcttctgctgtcggtgctccagctcctttgggtgagtgaagggatggttgaggtaagagtggtagggcatgtcaaccttcacggcggtcgctgcaacctcaaagtcgctggctcgcttgctcaggttattcttggtattacgatagggaatatcaacactcagaggtgccgccattggggatacaacgcgtgccattgttcaggcaaggatgtgttacaggatgagataaagatgtaagggaagttgcacaaatcaaattaggaaggcaacaggtgcgagaaagaagaagggaggcgaagggatggagggagggagggagagagagatagagagcgtgcgaaagagctggagagcgagagagaaagaaagcgagaaaaagagtgaaagagtgagcgcgagagggaaacagaaactccaccgagagcgagaaagaatgcgcgaggcgagagggagtaggcgagcggatgacaagcgagggagtgagaggccgcagagaacaagaaaagaaaaagaaacgaaatatcgaggagagaaagttagagagaaatatgagagcctcgatggtgcgcgtgtaggagtgcctgcggggccttgatactccctatacccgcgccatcttgtacggcgcgacgagggtccagaggtcgctgtatcgtagacctaacatccataagtgtttgagaaaaaataacctgcaccaatacaccttcaatgtcatggccgaaacttccagaattccttaacagctaattgttttaggatagcatgcccttgcttggttatcaaggtggttgtgagaggacaacgagcctgctgccgacatggccatctttttttttttttttttttttttttttttggcagttttgcttgtgctgtcatgacggtcaattgttaatttttaacgcaactccttttttttctctcgctctttctttcacgctatcctcgcgagacgggcctcgtttactgcaggttggccgtcgggatcggagaatggggtgccgtacatgtgtgaccgtctggggtggtgtctggctcaacctcctttcttatggctgcgaatgagaggtttagcagcaggttgtcatcattgtggtctctccttgctgtcccttgctaccctctacctcacttccccttctttttcgtcttgagatgatgtctgatttgttctttctactatcagcccgcttcgccacctccctgtggtggcgtcggtgcctggaccctaaggttatgccggtgcgaggacctgggactctaaccctttcacctgccaaatgcagtccgccttaaacccttcctttctttttcaggatgtgctcgaatatgcccatgctcgcttttcgctcattcagtgtaacattgctctctctcgctcagccaagcccaaacttggtgaaaatgacggtgtagcgtcaaaggtccgtcgtggtttatttccagcgccatttggaatgaaggacttggatgcatggtatgcaaggcgactgaggcccagtaatagcaggtggagccgaaggacgctatgtctcaccatatcgctactacatccctgactcacttgtcttggtccccgttgcatcctctgtcctatttgtctctttatcattcctggaagcatcaataacgtttccttggagggttacaagactgctatagaagttccccgaatggtgtccacagttttttgattctgcagagctatgtccgcgtctgacaagaaattgcttctgaccccagcaaccagagtgaaatgtatctttgcacttcgatggcatatacggagggcggggcataggcacttttatagcagcaaaagtgcctatcgccggaaagatttgtcaggaatatcattgagcctcacacaggttgtcttgaacgttgctgcggttcgctccacattccgcgacgacaaaacttactgtgagcacggaccatttgcgtttcaagcgaaagcagcgcaagcgatagtcgcgtataagacgatcctccggactgcagtaattgccgggagcgagagagttggcagtgagtaacatatgtgaaatatcggcgagcgatagagatgtctccccctctcccccaacatcagagatcagtaattggcgcatccactcaacaaaagtatttgttcaaaagtcaacggaaaaattcagccgtgcttcaggggtttcatgccaactccttacaatatacgcgcctgtgtttgtttcaaaatggccacgttggctctatgctatgcttcaatctcataggacctgggtaactgcaacggctaaaggtcaaaaacgcccaacggtccgtcccctctgcccctgaccacaggtgatactgaagagatactgataaactattgaccgatcctgcacccagcaagtcgggttggtggcatttgcgcatctcgtcacatcgtccagataatacaggaagacaggtctagatcctcaatcgtacaataccacttgccgccggtcgtaatggtagtcgacgggtggcgagacacagtttcttgatgatgaagaggcgatatctagcagagtgcgagcgagcgccgtttgcactaggctgatgcgagaaacatgcattcatgcgccccatatcccttgtttagcacctctccgtgttttttcttatcccttcgcgtctcttctttccccctggcaggttccctgtgcatcgctcacctgtatcttttttcgctctctgtcgtacactgccattgcactgtgaaagtgaacgtcaacagtgggagcaaagctagcgcaatacatccagaaggttcatgcgccgctgcttttcttctactctctccttgcaagcttatggccaatgctgtggatcggtgcccgagctcttttgcactgggcgttccaaaaagccgtgggtgctctcacttactcgtcgaccccttgcttgatttgtttttccttctttattcagaactaaggagcgaggcatgtatgctggccaccacataatggtcttatgacgacgcggatcttgttcatggccatgactatgggtttcaaaacacttgcggcgcatcttgaccagggcaccctagaagatgcacgcccgacccgaccgcagtaatagtggcagcggagttcaatgatggaggggaagctgcaaggcaccagtggccctggcttgaagcgcctctgcatgagcgaacaggccttcggtttgtttgcatagttaatgcggtgagcaaacaggggggcaattggaaattggggagggagcaggggggtaaggcaatgggcgtgggtcaatcaagcgaaaaatgaaaaatgcgttgttcggctcgagccgctctgtgttctctgttgtgtgccgttcctttgcatgctgccgtgctatggacatgcagcgtgtcagttgcagcgctgtccgcccacggcccttccgttccccagtcccgcattgttttccgctgggttgcttctgcgctgcctcgcttttgtttgttcgcgtttccaaaggcgctctcgttcttctctggtcgctctccgttcactctctccgtctcttctcttttcccttttccctttctcttcctctgtcacctttttattcccctcaaccttcccaacccttcttttctctttccttcttgtcctctccactctcagtcccttgttgcatcccactacaacccagccagcgactcattccgcaccttggtgatccaccatttctcgcttcccctcaactgtccactcattcctcatttcactttattcatctcaccttgctcctctcgcatcccccggctgaccacacaaacaccaccacgttctcacagctcctctcctcacttgttcaagctcctctccgcagccccgatcgttccctgactgacacggcgcaagattattttagacgtatctaatcaaaaacctcacgcgtcaagcagcctggcagaaggttcgtaggactttcttggtcaaagatcaccctttcacactttttgttgtggcagtctgactagcggccggggtccaagaatggcggtgtgcggggtccatggacagtcatgcatgatgctatgcgcacaattgacttagggcagggagagggccactcccttctctctctctcctccataatccctatcgtccgtatgcgccttgtaccctttttgaggagagatggagctctaggaagcaagagagagtgaaaaaagagagggaaaggaacaaagaaacagagtgtgcattgcccttctttcaccccttgctattcctcactctctacatatgcctgcaccccctcgatcctcacagcttcctggctggggacttggactagaaggagacaccaaaaaggaatagagagttagttgcctttgctcctcgctctcttttctcttctctttggcactcccccccctcactctctcttactcacactacctttcgctaaatccagcaacaccgacactggtccattgtctatcaccattctttatcacctggggtaacaacatcttggactaaatgctgtcttaagaacatgtatctccgctcgacggacgaaattagtacgcttagaaagagagtgaggaagggggagcaaagcacatggagcaaattacagattcacgacaccgtcgtccccagcttttcacttcacgattcaccgcctctggctgtgaaggaaggagagatcagaacggacaaagctcctcatcggccgtttggttgcagttgaggctttatcccaatcctcgctcctggaacatgcacacgctctgattcgcacgaagcacgatgttcgcacatgctgaccaatacttcgactgctttatattttcgttcatgattctagatattcctcgcgcaccctctcgcagccatctcgccttctcttcacgttatcataccctcgtctctcaccgcaccccacccgacttgaagacataagccatgggttgctgcatcagccaagaagacaaggagggccgcactcgcaatgaggccattgagaaccagcttcggcgtgatcgcatgcaaatgcgcaacgaagtcaagatgttgcttctcggtaagatagaatgataagagtagacccaagaaagcgattagctgctgcagtacaggtttcaggggactaacgcatatcccctcgaccccatgaatgcgtcggatcacctcaccacaggtgctggagagtcaggcaagtccaccattctcaagcagatgaagctgattcacgacggaggttattccaaggaggagcgcgaggccttcaaggagatcatcttttccaatactgtccaaaggtatgctaggaaagaagaaaaaacactccgatgcctgcatgcaggcagagtccttcgccatcgcagtgatgcataatgagagcgggcctgtctgactgcaagggaacatggacaataggggggtttgggctaaagagaataacagtcgggcaaaagggtcagtgcgcggagggtacctgacaacgcacacacaggtgatgatgactgcctccacactgcacactcccttcccttcccttccctctcccccttctttcactttgtttgtttcgtttcttctcttgtcctctacatccccttctctctcacagcagaccagcccctggctctccaatgctctgcgcgtgcgatgagagtttgtgatcgggtgggacatggatggttacaccaatcgtgcaaaagaagagattacgatggcggttttcgttgtctggtggagcgtctgagtttttgttgcgttcatgcgcaataggggcgtggtacaacgcttccgctctaatgcaatttaaaaaaacatgcgctttgaagaatttgtccatcttgtttggtggtcgtggtttatcgagcgttggcccctattgtggagagatgtaaacagattgcaaataacaggttttacaccaaactgtggtccctctctagccaactagcctgacgcgtttgctaactgtcgttttgacccgtccttgcttttaaaaaaaatcgctatagcatgcgagtcatcttggaggccatggacaagatggagctcccgcttcaccatgaggccaaccgcaattacgcgattatcatcatgagcctgccaccgcagatcgagggtgaatacatgcctcatgaggtcgcgattgcggtccagaacttgtgggtcgatcctaacgtacagcaggcattccaacgcagccgcgaataccagctcaatgattcagctaaatagtaagtcttaccaatgtttgctcagcaacaaccaacccctccccatagagcctcctaggtaactaacctcatctattttcttcgctgtccccttttcgtagctactttgactccattgaccgaattgccaaacccaactatgtccccacagaccaagatgtgcttcggtcgcgcgtcaagacgacgggtatcacggagacgcgtttcgtgattggcgatttgacctatatgatgtttgatgtcggtggtcaacgatccgagcgtaagaagtggatccattgcttcgagaacgtcacggccattgtcttcttggtggccatctccgagtatgaccagttgctgttcgaggacgagaccgtgaaccgtatgcaagaggctttgacgttgtttgattcgatctgcaactcgcggtggtttgtaaaaacctctatcatcttgttcctgaacaagattgatcgcttcaaggagaagttgcccatctcacccatgcgcaaatacttcccggactatgaaggtaaaaaaaaagtgtctgttgtgtttttgacgcgactagtcaagatctggttgaactctatcagtccgacgttttagtattgaagattctaatggtatggttcgcattttgttactctttcccaggtggcgacgactacgaccagggattgcagtacatcctgaaccggttcgtgagcctgaacctctcggataccaagcagatctacgcccacttcacatgcgcgaccgataccaaccagatcaagtttgtcatggctgccgtcagcgacatcatcatccagaccaaccttcgcgagtgtggtctgctgtgagcgaacgaagaaaagaacgcaacctctctctctctctcacctgcactcttcctcttcattcgtcgacacctcctcagattctctgctgtacagaacctttcaagcgatcctattcaagtggatcgaggaagagggtggtatttcttcgttccttctcgtagcctccgccactttcccactttccacgttttgttttttcgttgctgcgagacactgcgagagcagcagttccttatataccaacccgaaccccccccccctgtcatctctcgaccgcccactgctgtcgcctagggaagtcaagccatatatcatatccatactaaatcacaagtgccttacaataatatcatttttgttcttgtcttccgggagccgctgctcttttattgtgatgctgtctgtccaaaatcttggttgaaagcttccagaatcgcctgtcccaactctaggttggtctgctctgcagaagctgaagcattcgcaacgtcctcctctgtgtgtccactgcgggtatcggtctcttcgtctacagagatggctttagcagccgctgtcttcacgtccttgtcctccgtattccccttatcctcgtcgtcatcatcatctgaagaatcgtccgagtccgaatcatcactcgagtcgtccgagtccgagtccgagtccgaatcggactcatcgctcgatgcatctgaagactctttgctctcgtctcctgctgttttgaccttctttcctggcgtctcgccttcaggggctgtttcgttgcttctcttttgatccttgagaggcggattcgtctgctgtggtcctgtcgttggcttcttgggccattctgttgggggttcttcaattgagtatttagccagcaccgaagggaaagcctctgctcctcctgcttgctccgatccactgtctacggtgccgtttaatgatgcctctgatgctgtagacggcccaacgacaataatcgtggggtactccaagacctttttgaactgaagtgcatcctgtaccttgtccgaggccttgagggggtacagcgccggttgattagcctatgaaaaagtgttttacaaacgaaaagtaacatgttagcgctcagtgagaacatttccgaatatctctcacgatacacgtttttgttttgttcagagttagcataggccttacgtgtcgcagtggaatgacgaaataaagccggcactggtccagctgttcaaaagggtattttcctgcaacatcgctgttttctggcttggacaaggtccctgctaaaatgtccttcaaggtcttggattcctcgttcttgtgctctagtatcctcctggaagtctccatctctgggaacagccactcgatcgtccacaagaacctactaggcctacatggatgaaggaaagcgtagactgtcagccgtccatacgagcctttttgtaacgacatagaagaaagaatgaataaaggtcgacgtacttgtctctccagtgggtattgttctctttccgcttcttgagtccatctgccatcatgatcaaatgtgtgcccctcttcttggcctgcaaaatcaactgcttgtccctgtaagatccactgccttcagcgccttgtttctccagttcctgagctgccgtcaacgaaagctccgtgaccgatccaggacctgataccgccccgtctgcggatgcgtcctgttgactctgtcgacggttattctgcatgtgagtcctcttgttgttcttgttctgatggtttgcacccagaatgcgtttccggttcgggttcaaccccgcatccagtttgacgttctcacgagcggcgttgtccaccgtcctgccgacctcttccaaaaagttgtaatctaaccaagcagattttttatagtactgatcagcttccccctctggtgaaaagacatcttttttttacatacactgctttgttttccttgttttgtttgaagttcttaccactcatcatatcctgttcactgtactgttttctttccacaaaatggattctggaacggacaccggagcaggtggtatcgagtttatgttgcttggagcactgaagggagcaggtctgacagaaacagccagggcacttgtacttggctgtgaccttgccacagacttcacagttgacgacgtcggaagaggccgcaatggcgttctcgcggatctggatgccgtccttgaccaccacattgctctcgtcgaccttgtcccgttcgacgaacgcattggcaaaaaagtccatggtgcttgtgtgtaggttgaatgcagcaaagttaaaaagaagacaacagttgataatagcgttcctgctgctgctagagtggttatgaagagtcaagagaggagagagatagagagagatagagagagatagagagaaagggaaacacaagaaacgcagagtgagtggggaggagtagaaaggagaggaagacgagtgaatgagcgttgggcaagagagaagctaaaaaaaaaaagaaaaaaaatacaacgggactgcttgctatgatagcactataaaattttacttcggtattcagggccaaaaaaaaagctctagatctggataaggacattgttgctgttgcgcggttgcttaggggccggttgtggtactggtgtggactcaaagaccgaggactggtcctggggaacagtctgcacgatgtagtcgagttccagcataaggtcgtagcaaaagtcatccagcttcaagtcgttggtatcaaatcctattagaacacccaattctctgttagcacttgttattttttttcactacatacacatggtatgcgccctatacagaaagaaattgcagcaagtgccttaccaaaaggatcctcaatttggtttccaatggcctcaataccaaacagcgtaaaggcaactgctccgcagagaggaatcgtcagccatcccacgtcgcggacagttgtaaagggcaaaatacagcagtacatggtcaggatctgtttcagatggatgttgtacgccacaggaatcggggtcagcaggatcctctccaagttgccgaagcagtcgatcatagatgagagcgccatggtgcactggccctgataaggaatgtcgatcaggtccttgtccttgacatagttgatccagagcgagagctggtacgagatctcgaggggcagcgacatggacgaggacgagttatcccgctcaatcacccagtcattcctgtccgtccggagatgaagtcggtggttgatgtactgcgtccgcaaattggtcgcgctcttgcaggggacaaagtcctctggcagcaggccctgaaggtctctgtacgaagttccatattctgcacgcagatggtgcttggttgcaactgcaaacgcgagcagcatgttgatggcacggatcttttggtcgttgatgccggggggcccatcgggcttctccttgatgccgacccaaaacactcgtgccatgttccggatgctagtgttcattgttgtccagatcttgcgcccttcccagaatcggtcgtaggctgtgttggttctgaaggcgagaatcaaaccaataacgatactcagagacccgactatggcagccaagcacatgaaacagtaaggcatttagagttgtggatgagtgtcaagaatagagagacgcttagactgaaagggcgccgttcctgacagcagcagcgccttactgacagatcctgcgacagagatgtcaatgccaagggccaagtagaggtaactgacgcagactgcaacaaagaccgagaagaggacattgggcaggataagcggaataacctatggagcgaccgttaagcgggttagcagactgaagcactgggaaattttcaggcaccgcgcaaggaaggaacggccaagacagctgaggaagagctcattgaagaatcaatgttcttccgtttctgcattgcccttctaagaatggtttcgagacttaccgagccgcgccagataagggcaatggggtatccccaaggactttccgtctttgctgtacgcttaaccattgctataggaggcgcttcctgaagtgctagtcgtgtcgtccgtgtcgtgacagttcgagagaagaatgcaggcgaatgaaagatttaaaagaaacgagtgagcgggggaagggcagcgaaagaggaaagttaattcgggagatggacgaacatcgcctttttatgcatgttgatgctctcctcatcacgaccctatttttttttgttatttttttttcatgagagcccttcacaaacaatctcactttctcgaggcacaaaggcgcagcgacggtggtggatacaatggacctttgcaatatattttcagtaagctatcgaaattgaacactacttcaggtgctgcaaaaccgcaaccatgataacggtcatgcgcttctcaagacctaaaatccagcgggtctgaagctcggggctttaatgtcgagggacatggtgcggccggagaaggtacgcgtgggctgcgggcggatatcaaaggcaggagcgatcattgtggcatcacggagctgcttttgctctctgatcgtaaagactttaccaggctcgggtcccttgggttgacggatagggtagatgatgttgcctgccgcctcaggagtcaaactgcaccgccagacagtaattcattgaccaaggaatgacaaggttagtcaacgcactgacatatgagtgctgttacatcatagttgatagtccatcgaaatcaaagacttacatcatggactttctatacaatgaacgggtgggcgatgctgatcccgaggtggcatcagtgagaggactcttgacctttgtgagcggactctctgatctcaagcttcccgtaccagcaaaggacatgggccgttgctacgaagaggaggcgaagcaaatataagtatcaaacacttcaaatatctggtcatcttgcattacagaatttctcgtcgctttttaccttgggggatctgcgggcagctgcctcaaggagagcactgggtggaggggtcttcatgatgatgagcctgcgcaaattaccctcgccctcgctaaaatggtacaaggacaacttgtctgcgatcatgtgcaagatcttgcgctgacgagcactgaggttctcgggaaagatcatatcgtccttggaggagtcgccccggaacatcaagaggcggtcgtagaacgccagggtctcgccatcattgaggtccagctggttcaatgaggaggtggacgagaagcgggaatcggtgtcatcacgatccatgctacgtccagagttgtgtcgctccaagcggttgcggcggtcgaattcacgattctggaactcgagttcacggcgctcctggtcccgccgttcctgctcgcgcctctcctgttccagcagctgggcctccagcaactccatgtcacggcgatgaagggcttctgcggcctgggcggcggccttgtcctgctcgcgcttctcttgctcagctgcgggcatgaccttcttgaactcgacacggagctttcggccagacacttcgaggccgttcacagcgctgacgacaatctcggtctcttccgcggtgcgataattggcaaaagccaagcctcgaaagacgccattgtcgaaatgatagttgaacgcgtaaggctttggaatgtccaagccgtcaaggatagccaacaaggaatcgcgcttgaccgcaaaggggatgttcttgatgacaatcgcagtcgggatggtgtcaacaggttcctctgctgcaggctgttgcgattgctgcagctgctggagctgagactgaaattgcgcctgctgaccaagataggggtcctgctgctggtagccatagaggccctgttgctgctgacgagggtcctgtgacagcatgggcgactgcaagggcgacccctgagaagggctccagttctatacaaaatatgcaaacagcacgacaatatgtttgtggagaaatggggggttattaataccacaaccgtctgagtaacatgtcacacaaagagcaaaaaaatattccggtactcgatcgtgtgtatacacgtcagacacgaaacttacaactccaaccaaagagaggcggctggactggcggcgtacatccttcacatcgcctctgctgcgctgggaggagccattggtgggcttgcgagcgacagggctgccaggggcacgttccgagccatactgagagtagcgacggtcgatcggggaggagatgccgttgtcacgaagggacatggcctcaaaggacatgtcgagctggttggtggtcattgccgcagacgacaaaaattacggggacaggaaggacaggaaagggtcaagggcacctcgtacgtgaaaaaggtgcagtgagtgtcgtattcctacgatgctgaggtgggccagaaaggttgtaataaaaaggagacagacaaaagcgaaaatacagaaacgaaaaagaataaagcgaggggtaggatggaaggatgacccttctgatgcagatctctcacgagggagatgcaggttcgttgcagagagcaagactctgaggatgcgggtgttattctatatacaaaaatgggttcttgatagcttgctgttttttgtgtgtgtgttcgagcagagtatatacagtgatgagatgaagttcgttgggggtgcggtgtcggcgttgaattgtggggtgtgcagtttttttcgagggtgggtatggtttgctgggccgcttccttttttttttgatgggaagtgttcttttttgtttttttttgaggttggtataatcgtaaacgtggaggtgacgaacaagggtgcgcaaggaacaaagagcgagagaggaaagaaaggggggaacaagacgagatgtagaggagaaggggtgagggaacgtggaaggaaaggatgaagaaaagtgcattgcatgatgatgcaaatggttggaatacattatccgcccgtaattctccagttctgtgacgtatagatccaagtcctgcgctcgagcgtcgcgctggattatggcgagttggtcgggcacactttacccaccttcacacatattccacacgatgtaagagcgcttgaccttggccccagaaggcggccgaggatggccctatccatccatccatccatctatccatccgcgcgatgcctgaccccagctcgcccctcccccgcggccctgatcatcgcgaactcatcgaaccgaccatcgttctctccatccctgttcctcccagttcccagccagcaccgagtggcttcggatatctggcgagaggtgcctcgcatgctgcttcagcacatggagcgagtgtccgatggcaccctagggatcacgggatctcctctccactctctccacatgcgcagaagcacagacgacacccacttttcctctgccctctgcccacttggacccatcactgttgccatcgcacgtttctgatctacgctcacagcgctgatcgacagcattcatgatctcgtctacgccaccaacccagttcgacgtgggtcactacctcacacttgatccaaaagacaatcaggagcacacgtcttgagtccttactcgcactgcaccagcgaccacttgtacacactttggcgttgagctcgaactgccagacctctcgcaccttcaaggctgtagctgcatggctcgcgcctcagcactgcattacaatacctcgactctcgtctctccatttcaatccacctgtgctcttcgttccacactctactcaccctcacctaatactgtgcggacctgttttgttgaccctgccccattgcattcttctcttttgaatccatcaatctttcaggaccgatatcgagaacaagaccgcctccattgaagagatccactctggctccgagtccgactctgagcaggctgttggctccacctccagcagagttcagtctcgcggtgagatcaaggctcgcaaggccttgtccaagctcggtctccagaagatcaagggtgtcacccgtgtcaccgttcgccgctcaggccagcctcttttggccattgaccagcccgatgtttacaagtccttgaactcggacgcgtacatcgtctttggtgagggtcaggccgagaactttgatatccagtcccagctcgctgctgctcaggatgtcatgaaggatgctggcgagcccaccgctgaggctgtcaaggaggaggaggaagaggaggaggagaccgttgatgaggagggtgttgaggccaacgatatcgaccttgtcattgctcaggctaacgtcagtcgtgctaaggctgtcaaggccttgaaggcccacaacaacgatatcgttaacgctatcatggtaagactgttgctgaatcattaggccgttctctctgcccatttcgaaaggtttagatgggtgatgaagcttgatgctaacgtgggaccttctctttcacttcattaggaactcactatgtaaatcacccttcacttttttcacgatataaaaaatcccatgttttaacctggatgcttgcgcgaaaggactgtagtggcgggccatggctcctggaaatggccaacgatgcgaatggaacagtacaacgatgtgctcgagtcaggaagcattatgacagggcgaatcggattagggctcggcgtcagggtgcttctgtatgtttccaaagcgactactgcgctggaagggtctttggcctcctgcaatgctgtcagttgaaaggaagacagatcatggctcgacattggataacaaaggagatgcagttggaaccaacagcacgaggcttggccggtttattattgttacaatgcgagtggaaagtatggataaatgcgaagggtgtactcggagaactccatcatgtagatgggggtatgtgttcgctttgactgcttgctagcttctgacgccaatattaagcacggtggagagagctggaagagctattgttggaagaagtgatcttgtcagagccagggttcaaggggccgacctgggaggcacgcgaagccttgttgttcctcttgaaggagaaaaggctgtttgatgacgaggactggcgaggagacatcgaggaagaggcagaaggtgcagcattgcacttcatgttcttgaagaaagccatcgatgatgtgttggtatccatttttttttttttggtgctggtggctggaaggcacaggtgaataggtcgtttagatgggtatggtggtggtggtttgcttttagacaagagcgagtgagatagagcctgtgtattggtgattgatgaaaacttgaaaagtgttgaaaagcggcagctcttttatatctgttcctagagctcgcttatcttgccagtgcatggaccccgtagaccgctatcaacccgggcgcctaatcatcacccaacaccgaacgaaaatggcgaactccaatgtcgttgtcgtttccctcaaaatcacctttacaatactgatcccacaacactaagaagatagagctgcgacaaacgctctggaaaaacccgatagaagctgcgagcaatattttcagcgtccgcacaagaaaatgccagatcagtggcacatcgttgaaggagagataagatcggccattgaagaaagtcctgaagccagtgcacggactttgaaattatccgaatcagacattcaggggcagacatggcacccacgtcctgctgatatctacaaaagcagtagacccacacctgcagaagccgcccgttttgtagactctatgacaaccctggccacctgataaggcggcaaacgaaatcggaaaacctcttgaagcgacctatatagctgtcaactgtgctatggcgtggtggcgcttggaaatcagcgtagaatcgcttgtggtttcagcacatgcaccggtcctctctcttgattgacgcttctatagcccgcacttcctcaacaatttttcagcacatgtcccgctcctcctttttgattgacgactcgactcatgattgtccagggttaaatgttggagcgagtcaaccgcccgaacataaactgacgctcttgtacgctcttgtacagtgaaacaatcttgctttacacgactatcgctggaatattacacaatgtcatacataagccatcgagtatcgtctgtcacgaaccgagtcgaaggtgtcatctgctctcggtcgaatggccgaggtatttgcaagctggcgtacgtagttgggtcggcttgctgctcgcgcatgcacctgtcttagacagatgttcagtacgactatttttaaagtcacattcggcttgtcttgtccggctactacatctaccctgagcaaatccttggcgaggcgagccatcgtatgtgaccgatgacgctgtagccgcaagaccttcttaaagcgaagcgagcattttctgtcatccatgaagtcgtggctccagaatgaggaaaccacgagtgataggctgttagagttcggcgctggcgaagcctggggttctcgaatgggcgtataggtgcctattggacgaaaatggaattttcaggccacacggttgtttctcagccatgtttatttttatgagttcgtttgtctgttgcgtgctcccaggacactcttgaaagactatacgtatctgttgtaagggtccaagagcgataaacatcaaattttcgcatgagccatcaaaaagtatattgcaattgagcgtatagaaagaccgacaggggatttacatggcgcttgatactgaaagttcgcctctcaatcttcatgcgtcttttgtaacgtcaaagccctggaaagctctcatcgcaacaggacgccacttgcgccagctttattacaatttatgcagtcgagggaagccatatcgcataatattacaaaaaaaaaaacgcgtttcatggtggtatggtgcgggaggtatgcgatgattttggtggtcaaacatcccatcgagggccgtggcaggcccgtgggtgttataagtaacgagccacggtgcacaccaagggacgaaaaacggagccgcgagtttgtgttggaagtgcaggtcatcatctcgcagacaagcgaggcaattgctgtaacgcttcctgtccgtgtgctggctacctgctgttgcaggcagggatggaagtgggtgttcgagaacgggcaggcaaaaggcattaggcatcatcctacagcgtcaatgaaaccgcatgtagcaaggatcaagggggagtatgctagcacaccatcagacgtctctcaccgcacaaaaaaaccttcgcgtccccttgacgtatctcctcaaaaaataaggtctgtccctacggaggactgtaatgatggtggtagtgctcaaaaaagtatatgtgccatggctgtacagtactcttcaattctgaaagctgcggtcaagcatacttcttagaggtactggtctgatgcacgcctttttcactcgcaggcgctgcctcggccagaagtggtgatcagcctataagatatcgcatcgcgcattcactctcttttctgctttcttcttcacccttcttcactctgccgcccgcgctaattatatagcgtttccctacagcctgtttctgatccctgtcgtccttcgtcatttttttcttcttgggttcagccccccaccccttgtgctatccatgcttgctgaccttttgtaaatatcaacccattctttcacatccagcgtctctttcacggctcattcaactctttgtccatcctcgctcttaaactctctacttcacgccacctgtcaggcgctttttctcttctagcacacaccactctctttctctctctaccgtcaaacataatcatgctgccaaaacgcgcaagtctggctttcatagcctcaatcatcactcttctcagctgtggcccagctctcaaagcggacgctgccccaatcggcagatttctgtccttcatctcctcctcgcaacctcagcctcaagaactgccaaccgacgcacagctgctgcagacaccgccacggccttcgctaggaagagcccagatccggcctgtacaaagagcagcccacccacccttttcgcacacaccgccacaatcctcatcaccatcttcatcagtatcacccttttcgtcgtcatcgtcatcatcacaccctgcgtcttacgaatcctcagcagctgtatggtacctgcttcaccgagaacagcaagggcaacaacagcagcagtcattgcagcctcctgctattccagcgaagcctcaagagacacaacagccatccagagatgaaagcaacagttggtcctaccgcacgcttaacggtcatgctgtgttggatgacgatgacgacgacgccgggaacgagttactcgatacagaggcggatgagtttctgcgaccggacgcagatgatgaaattgaggggaccatcgaaggtgaggtgttagaggaggaagggattgacgaggacgaggacgagttggatgatgaggaggcggacgcgatctgggctggcgttgtagagcaaatacttgccctcaagagtcagcgtcaaggcgaggttgaagcgaccgagttgcggaaggtgttgcgaaaggccgaaggatgccaaatggcagctgatgcggacgagacgctcttggtggagaaggcatacaacgatggtgattttgagtgagagttcccctttctctcactccatccctgacagaagggggacagcatttcgccccttcttttattgccactgggcgctctttgtgggatgtcttgtgttgtagccatactccacactgacgcctactcatgtatatagaatggcttttttacataaacgaatcgtcatatgtagtcgtcctttgcagtagcaccaaagacagctccatgaaaggagagaccacgacgacagggcgaaactattcttttgccaccaaagcgcaaaacgcagtcgtcaaatgtgcatttctggtggcttgcataaaacaaaaaaaaaaagaaaaaaaagtcaaggttcctcgccagcagcagcgcatgtccagtgcgcctttccattcctcactcctgggacagccctctccttcacctctcgacccgtccagcatcagtagcgcccttacccatccctgccacacccgagaactccacagctcctcacgatgtttggaattccacaaaagaaggtccggacagaggcacccaaggcagtcgcccctcgtatctttgtccctttccgcgctatcggttatgtcaccaacgaggtccccttcagcatccagctcaagggccaggcatacttcctcaccacttgtgtcggctccaccttccacatctatgacattgccaagatgaacttgctgtttgttggtatgtagctatgcagcaacagtgatctgtttgacatctgtgtgcctaactgctgaagtcagcaacgcaaaatatgctaacatggcgctgcgtaactcttcccataaatcaggaccacacactgctacacctatcacagcactggcgacattcaacgatctcgtgtttgtggcgactggatccgacgttgtgagctataagagagccaaggaggtcggtcgattctcatgcggaacagaccccaaactatcaatagcctctctagagatttttggtcagcatatcatctcgatctgcagcgacaactctatcaagttgaacgaccataccactggaggtaaacactggagttgtcagataagcttcgggatgagagatatcgtccagcgcttcaactgatcagtccatgacttccattctgatagaactgtacaccaccatcgattttgactcgtcattcaccgccacaactctgatccaccccagcacatacttgaacaaagtcctcattggaagcaaccagggaaccatgcagctttggaacatccgtaccagcaccatggtctatgcgttcaagggattcaactctcctatcacatgcttcacgcagacgcccgttgtggatgtcatcgcagttggacttttggatggctcgattgtcattcataacatcaggaccgatgcaactattatgactctgaggcaggagggcaaggtgacagctgtcacgttccgtactggtaagcccgtaggattggcttgcacaatagcggcagcaggaaccgcttgcggctgatgatctaactcgttcgctcactgcgccctcataaccgtagacgatcagcatgtgatggcctctgcaaatatgtatggagatatttctctgtgggatctggatcgccagaaggttcttcatgtgatgaagggcgcgcacgacggtacgatcccatcgatccagtttttgaatggacagcccatcttgatgagttcaggagccgacaactctgtcaagcagtggatctttgacagcttggatggactgccacgtctgttaaagtcaaggagtggacatcacgcacccccaaccaacatcagatactatggagaggatggccactttattctctctgctggccgtgatcgctccctgagggccttctcaaccgttcgtgattctcagtcgaccgagttgtctcagggatcgctcagcaaaaagtcaaaattgctcaatctcaagattgacgagctcaagctgcccttgatcaccactgtcgccgccgcaccagccaaggagaaggagtgggataacattttgactgcgcattggaatgaacccggcgtgcgatcatggaactaccaacgaaaggctttgggcgctcacatcttgaaccccaaggacggatcagcaaccaagacggtcgccatcagcgtttgtggaaactttggttttgtgggctcagctgcaggaggcgttgatatgttcaacatgcagtcgggacttttgcgccgatcgtttgaggaggatggacacaagaagtcggtgactggactccagtcagatcgcttgaacaagattttgatctctggatccctggatggcttgctcaagctatgggatatcaagtctggaaagtgtgaacataccatggagatgccctcgcccatcacccacctgctgctctaccctgaaaacaaccacttggcggtgatttgtgacgatctttgcatacgcattgttgatcttgagaaccgccgcgtggtcagagagttctggggtcattccaaccgcatcacagacatggtatgttatgatcatgactctgagattttctgtaactctcattgaatggtatatctaacaatcgtatatattcgtgcttttgtttcacccatagactttcagccctgatggtcactggctcgtgtccgcctctctagacgcaaccattcgtacctgggacctccccacaggacacatggttgacattttcaggtgtgagagcatcgcaaccagcgtgtcattctcgcctacaggagactacttggcaaccgcgcatgtggacaacgtcggaatctttttgtgggctaaccgcatgcagttcacgacggtgtcgctgaggagtatcaccgaggacgacgttattcgcgtcgcccttcctacatccacgaccacagaggaggatagcgaggagagtacgtatttttgtcttgttttgtttcttcttttgcatggagaatgtcgggcctgtatcgaacactgacacaattgttgactactttatttccccacaacagctgaaaatatgtttgctaccaacgaagagatcattgccttggagcccaccattgagacacccgaccaactgacggagcagatgatcactctctcacttgttcccaagtcaaagtggcagacgttgctaaacctggatgtgatcaaagccaggaacaagcccaaggaggcacccaaggctcctgagaaagcccccttcttcttgaacaccctgcccggtgttgagcccaagtttgtagcgaccaaacaagacgaggagcgggcgaatgctggtgattccaagatgatccgcatgagcatgcttcagcccgagactgtgttcatgacactgctgaagaggggccacgccaccagcgagacccgtcgggtagtgagtgccggacagaaggacgaggatatgatcatggtcgagagggactattccgactttttcgaccatcttaagactctgaacccttctgcggtcgactttgagttgaggtccatgtccctggacaatgatttggcggagccgagatactttttggaggcgatcgagtgcctgttgaggcaacgaaaggatttcgagctggcagaggcgtacctgaacttgtttttgaagattcacggcgacgtcttggtggccaaccctgatgcgggactggatgacgagagcgaggacgaggacagcgagatggagagcgacgttgatagcgacgacagcgaagccaacagctcccaacgactccggatgaaggtccatgccaccaaggcagggcctttgagtgtcagtttgcggttgaggcggttggtggcggagcatcagcgcgagtggaagaggctggaggagctcttccagagcacgctctgcctcatcgagttcatgaggaccaaggcatgataagagagagcgagaaagagtccaggagaaggtagagctgcttcatagaaaccctgcgctcaaaccaacccgaactacaacaaaaaaaaaatacattcattctatttgcatacatatcatatctgaagagctgcattctgtccttccagcgctatgcctttttggtaacctgccagcttttttctcacaccacaccctcataaaaaaattttctcgtccgttgtcgcaattatcactttctcatccaccgctcaaaaagtcatccatcgcctgtccccatctcaaaatctgactggcgacgtcagcactgcttcaagagttggtccctcaacactcgcacgtcttcgagcgcgtttgctcactgtggtaagtcttacagatttctcacgatcagcagttgggttaacatcgactccgatccatctgcgcacactctcgctggccagcagtactcgttttgcagccttgtgacctgcggtgctattgcctttcgcaaacgttcttcttcaagaagtgatcaaacaatcgtgcgtaccgccgtactgggcctcggtagaagcaactgaactcagttgccagtcgaacactcatttggggcacccgaaagaaaagcacgtgacatacaacgaaaagtataagtcatgtgatttataaggatagtaacgtgacttaaagtggattacagatacattaatctctggagagcatgcatcttcaatcactcggatccaatgagcagagcccattgtgactgctgaaagagtgaacggtctgctggcccaatggaaaggcgtctgactacgaatcaggagattgcaggttcgacccctgcgtagatcattcttttttggccgcattggtctgacttctgggtttttcgggctctcattttcattcgttgcaatgactttttggctccaaggtccgggctgtgtgcgtgaaaggtgtaattttactgccagctcatgcaggcaagagtcacgggtgagatgtaagcgttgtaagcgttcgaaaagttatggcgaaggtttccttcacggctcaaaatttacgaggtcgatcggtaacaaaaagagagccgaagcgtatcggtctcgctattttctcctcttcactttgctgtacacgtctccatctcccctcttctactgattgacaacctcgggttacttgaatggaatctcttgaaaaactgcccaacatcgtgcggctgtcggagagggtgctgcgagtccttggcctgaatcctagcaagttcactctgcaaggtaaagaatgcagacaaatacgcgatgaagcccggctcagatttctccgaagcgacaatggacttgaggaatgtttctcaacgactcgcgcgctcatgcacttctgtttcttcaaggcaccaacacatatttgatcggcaagggtcctcgcaaaatcctgctggacgctggagaaggtctccccgagtatatccccttgctccagcgagcactcgacaaggaccttcaaggcgcctccatctccaaaatcatttgctcgcactggcaccacgaccacgtcggaggagtcccggacgtgatgcagttcctagcctcacgcaacattcacctcaacgagccctcccatcctgcgggtgccaatgcaggtgcgtcgtcttctctcccctccgtacacaagtatcctagccctgagcacgacgatccagagctgcagtttcaagaaattaaggatcagcaagagatcaaggtcgacgaccagaccactctggtgacctggcatacccccggacacacctcggaccattgcagcttttacttgaaagaggaaaacactctgtttactgccgattgtgtgctgggtcaaggaaccgctgtctttgaggatctgagcgcctatatcaagtccctggagagacaactgaccatcttggcgcccggtggaggaccagcctcgtacaagatctacccgggtcatggacctgtgatcgaggatgggccgagcaaagttcgagagtatatcaagcaccgtttggatcgtgagaagcagatcatggctgtccttggccatcctagtagtagcagcagtagtggaaactctagtcccacgggacagttggatccaagcgcggggacagcagggaaaacagccatgcagattgtagaagtgatctacgaggcgtatccagctagcttgcatgcagcggccgaacatcaggttttgctgcatttgaaaaaactggagcaggatggcagggtcaagagaggctcagcagaggaaatctctgatgctgtgtgggtgcttattcaacctacccaggcaagtctttgaaagggattcgttatccatataagaaaatgaaagggctgtaatgtacatatgcaaatgatgattgaaaggtctatgtcgtatcgagaaaaaaaaaagaaaagcataacgatgatatgtctatttgatctctgggttggggttgacccatgcgatcttgtcctcctccaatgacaattccacttcccacgaaatgtcctcctccggcttctcgatccaattgtcatcaaacagtgtggatggaaagacttcgagcaatcggcagtcgacgccaggaatcctgagcgagtattctctccagaaggtgttctgtgtcctgcccagaccatgaagatcaaacgacggcaggcgatccaggtaccgaaagatctgtccgatacccacgccgtttttgacaacgagatcgtacactttttggtccttgatcacgacctgcgatttggcattgcaaaagaccttgtcgttgcagagcaagttgacctcacgctgaaatcgtgcaaaaactgcggggtcttcgtcttgtgccagcgagacctctttgttttcgatgatgttgactgtaacggttttgttgaagtaagcgctaaaaaaaaaaagaaaaaagcagcatagaacgcagcacagtgttacaaaaaagggtgaccaaggaaacccccgtatttgagggcgatgacatgcgtacacacatacctgatcagacgctgcaggttgccgttggcagtcagcaggattcgttcaaaccctgtgaagccctcaggaagatgcaacgttgtgtctctaaaatggtttcgagttgcaagggaagtgttttccgagaggcaaaaagggtcagattccaagcgcgaaagagttgagtgtgcacggtgcatggctggttgttgtgtccctctcaaagacttgcctcttggacataatgtcaccaaaatggccaggaattttgacgattggcggactgggagagctttcgaaaagagtgggttgtggcatggtggtgaatggtgtgttcaaagggaggggtcttgtgtgaaaggggaaaggaatggaatgtgtttgaatgtgagatcagcaacagggtctaatcaaatccgcatccggaatgtgggaaagtagaaaatgaaagtcacagagctgcgttttcgcgcgtgggtatagaactcttcgtcctcctgccaagatactcttaagccattcggtcggtagaggacaaggtgccctgagagcatcgttagggggtgtgtataagaaaggcagaagggtgggcgtcacctggggattggtacgatgttcagagagaccagcgatcagcagccttgcttactcttctcgcgctgcgcgaccatagtgtcgcacactttgtcgttgggccttcatttccagagggctcttcaaatgagtctcgaactggcattaactttgtagtgcggtattgtgtccgactgagagtctacagcaggaaggacatgcgcccatgggcgggaggggaggcatgtatccaatttgctctcaagcaaaaccccgctgagcagaagcaacatacccggacacgcgtgcacatgtccatgctggtctgtcctggacgagcaaaagctgtctgtcggtccctccctcgccagtgtccgttgttctggaggagcgttatcggcgaaatcgctctgcgacatgggacaagcgtcaagactgtgtagttcagtgctcaccttctcttgggtcatttctctcctgtcccgcgctgctcactgctctgccatcaattgctgcacttccatggcatcaatgaactgttgtgcattgtataattagagcgcggtagctgccgttgattgatagagttgcccagcattgctcgcgcgaacaagagtgggaggatgagaatggtgtctttttttctttcctgcgtccctttcctttccctttcccttcgtattatttttttggttctccggtttcttcttcgtgctggtcattgttcccgttcctgtccctgtctctcgctcgctctccctctctctcctcgtgtccctcgtctctcctcctcgttaacatctctccctcacacacacacacacgcgttgcgcgcgcgctctcctctctcgctctcgttctctccctccctctccccctctctcgctctgtctttctatctctttctctctctccccctgatgagtcgtttgcgtttgtcccattcacacacttgcaggcgtcttgctgattgatccgttgtccatttcgcatcgctccaagccttttgggtctgtcccacatcttcccttgggtcgttttcccttccgcttctccttcccgccacccttgccttgtacttgtctggccctaatcctccgcgacgctatattgtctcacttactgccccacctcgctccatccatcgcattaccacctgcgctccttccgcacgcacgcactgatctccatcgcagccattccacccccgaggccccccctagtcagcagccatggagtacgagtaccagtaccagcacggctcctttgctgcgacagcttcaacctccgcgccagagccgtcctcgaggagaaaatcatcctacctgaccccaaagactccgccccccgtcccgtcctacccttcgcagcagcatttgggtcaacagcaatactatgaggatccatatccacagcatccacagcagcaccaacaccaacatcagcaccagcaccatgtgcagccgccatcacagcagtgttaccatgaaaacacggcctacatggatctggacaccacctcctcaccccagggcctgcagccttcgaggcagaagctcgcgcctttgcgtaaagtttcgaatggtgaattcgaccagttttcgcagccgcctatcatgactgcacctgtctacggcacggctaaatttgtgtcctcccagcaacagcactcgccgccgccgtattatgccacctcacaaatgccgagccaggagatctatagctacagcaatggcgatgcaggagatatgagttttgtgcagcaagagccgcaacatcaacagcaacatcaacagcaagagcaacaactacagcagcatcaacttcatcctcaaggtcaacagcaacaatactactttaccacatctgacatgcagcgcgggacgctgccaatgtcccagtactaccaagatctccctgctgcacctgtcctgactgtcactccgcgaagcaagcggcccaagagtctggcggcgcacgactttgtggtgggaggagagcaagtctacccgcgtaagtgtcctgtcgattttactggttcgtcggtcgggaaggctagagcgggggagggggggaaggagggataagttttttttacgaggtgtatcaaacggttagcagtgcaatgttcaggtacgggtgggtatgcagctccttgtccaacgaggcgctgttgaattttcaattattttttttttgcgcgcgcgcgcatatacgtcttgaacgttctggtatcagggcaaccgtctgtggtatgatctgctggacttaaatgtccgagcaagtgtacgaacagggcgggaaaaaaagaattacagaaaggggggtaaagagaggtgagatcatgaaaagttgcggtttggggggtcaaggctaaaaaaaaagaattattagccaagtgcgcgagtcgagaagcaaggaggcatgctcaagacggaatgaacggggggctgacgaagctgagagaggaggaaagagaggggcagaggggaagcatgtgggatgaggcgaaagaatggcagggatacagctgctgtctggaggcacgatccctttttttttcgtttcttcttctgttcacttggcttgcagttgacctcaacttgcaagctgcttttgcacacctctctctccctctatttctgcacccgcactcttgcctgccccctcgcttcccgttcacaagacacccttctccgcctcactgcgactcatctcgtccagctgtcacgcaaacccatcgcgcagactactccctgggaaccacatcatcgcatgaccacactctcgtcagcagaatgaatcgtaatcaaccactgcccacctgcaggccatgtgctcagtgcctctcagcttttatttcttgttgtcggagatattaaaacacagcctggccgtaactgcagcagacaattaacgctattcgtctcttatctacaacatgtagaatatgtcgacgacggtagtcggcagcctgtgcctgccaaatcccggcagtccattggcgccatcataccccaggtaccgaattcttggatgaccgaggaacagcagtaccagcaacagcagctgcagctcaaccaacaagcacaaaagaagcagctctcgtccagacagagctttcacgagttacagttccaacagcgacagcgggcatactcgcacgaagagcaactataccatcaccatcaccaccacaaccaggaaccgtttcagcagcagcagcagtattatcagcagcagttggcgcaacaggaatacaaagcagcggtgcagggcgccgtctcatcccagccgcgaggccagaccattgggtgagttaagcaagcaccactgggcgcaatgcgctgctgtttagtcaattatgcctgtcatgctcatgtgcacgtcgaaatggacgcataagtgcttcttgtgctacctgataatatccacccttacccctctcgcgagccgcttgagcaactcgtgctcgttgctgggatagtgtcgatttgaatcggccacagcagaccacagcagccaaccgagatggtgcactctacctacctgctcaagcaacaataacagagcagggaaaagaaaaagagaaaaccacaacatagctgaccctcttagtcacattttttcaaccatgggcaacagacaactaacatgttcacacctgctctgaaactctagactggatatacccatgtcacccaacccaccagcgacaccctcaaccaccaacacctccaacggatcacccatgaccgccttgacaagcccacaaagttcgggaaggagcagctcagtgctgttatcccaaaagatcgtatcaacgttgccgtcgtcaccttctgtctcgagtcactaccggaaaaagtcgttttcctcggttcctatacccctcatggtgccctcggatctctcacccatgccctcatcgcagacggggtcgcatatcgcctcaccaatgacttcaccttttgggtcaccatcaaagcacaacctcagctatatgggaatgctctccacccggaagcccagttcatccgaggtgccaattgtccagcccagagacttgtacaggcgttcggaatcttttggcgctctacaagcgcggactgtgcagacccacagcaacaacgggagctcgtcagacctcaacaactcacttctctcgccctctcaagtctctacaagagatcatcctatgcgctcccgcgaatcaatggaaaatgactctcggcaaggaacgatggattcccagcagcaaaacgactcccaaacagaggcttggcgggattcttggagagagcaggagcagtacctcctgcagatgcagcagcgggaccatagtacccgggagaaacataagcgggaaagtttttacgctgctcttgagagtagcaacaagagcgccggaaacatcagtaactattctggataccaggacgaaccccggcagccgtccaaagcgcattcgagggcaggctcgcctcatctaccctctggtatcccgtacgccaggacaaagtctcgcagcagcattccgtccacgcccacagctgaacagcgagctcgacccacgccaccaccgcgttccagatctaggactcctgcagggaacaacggacagtactcacagctctcgtcgcgaacccctcagcagcctcaagtccctcagcagtattctggcgaaattcaacccatccttcgaaaatctatcatgatggtcgacgatcccatgaccagttttactcagcggcccgacacccaccactctcagtcatcaaactctccttatagtcaaacaggcacaccacagcctcgagtcggggatgcggtcccagtcccagtagcagatatcaccaagcacttgagtgggttagagttccgtgaaccaggctcagttgtccaaccgttgccgacggacattccatcgaccggaacgcatatgaggcagtcaacatcaggcagtttgggaagcgctcaacgcaggagtattgtgtttgatgttccaaacacaccgacgcgttctcatgcgtctggttatgtcacagactcgagtgcgtacaggatgaaggacgtgggcgttgccatttccggaaccaaggatcgatactccatgttctccagcagctctcaaggtccaagtcggaagcgcggaaaggtaaaaaagcactgctaccgttttgatcatgctgttcacagatgcgacatcaagcgtttagtagtggcactgactgtttttcttttgtgattatcattcaaaagacgctctcggctatggatcctccaaaagcgaagcaagcgccaacgatgcttccgccaatgttcatgtcgacgacctccaggatgagtaatatcccgccacccatggcatcgagacttccaggatccaagatccctagtccctcacgaggcaactcctcgagttcaaaagactccagctcaaagtcgacttctcggctgttgtccgtgaaccaaccagcgttgacaaatcaggatgtgaagacgattcgaggcggtggcggcgccaacgagggtccctctgcacgggtgaccaactctgctctttcgcatgcggtttatacgaaccccggtggacctgatacgagcatgacggctggaatgtcgaatagcgcagcacccaaggtcaaagcgaacaggagcctttcgagcggtatcttgagtggattgagtcgccgacgatcagcagccatcgaaccggtgaatgttgggggagatgcatcgcaggctcccgtgaacgagccgacaacgcccaaacagtctgccttttcaaagtttaccagcggatccagctctgcgagacaaccctcaaatggtcagctcttggggcaatcagattcgaaaaagtcatccacgagcgggcttcggacaccgaccgcggtcaaggagttgcgatcatcgccttctaaatctcagcccaagaatccggccattatgtccaaccccatcaacatttacgcctccaaccagcccacgcctttgtacggtcaaggacccccatcatcgtcctcatcctcctcagcgccacagcatggagagccaaagtcaccattgggcacatcgagcgtcagtcccttcccgcccctgtcgccgtatgctgccttgaagttgtatgggcagtatttgagcctttatgaaagagccgagattggagagtacccgcaagtgtactacgtcggtcagaactgtcgacacaagaagcccgcgagcatggaggcgagcaatagcaattttggtacgacagtgcggtacttttcaattgcgatttcccaaggtctgcaagacaatgggcaacacaccttttttaacgggcagcttttctgatgttaggttttgacgatgagcgtggggattatttgatcgtcaaccatgaccatatcatgttccggtacgagattttggacatgcttggcaagggctcgtttggacaggtggccaaatgttatgaccacaaaacgggggaatatgttgctatcaagattattcggaacaagaaacgctttcattgccaagctgtcgttgaggtcaagatcctgaacaatttgaacaaatgggtaagagcaaaaaaaaaagctctttgagcgtcaagattggaagcataaggagagtgtacattggtgctaacaagtggagcctttgttccttttttttggtgtggtaaaaaattataggatccggaggataagcacaatttgatccgcatgactgacaacttttacttccgcaaccatctgtgcattgcgtcggagctcctctcgatcaatttgtacgagttcatcaaaagcaactcgtttcaaggcttcagcttgggtctcatcaaaaggttttgtacccaattgctccagacgctggagctgcttagtcgacacaatgttgtacactgcgacctcaagccagaggtattttttttctgtattttctggaatacttctgtccgttgttcgccactttgagcactttaacaatggctgcatttacttggaaattaatgcatcagcaaaaaccacttggttgtcccaatagaatattctgcttaagcatccgacaaagtctagtatcaaggtgattgatttcgggagcagctgcctcgagaacgagaaggtctacacgtatatccagtcgcggttctatcgctcgcccgaggtgatcctgggaatgtcctacaacatggcgatcgacatgtggtccctgggttgtatcctagcggagctgtatacgggctacccactctttcctggcgagaatgagcaggagcagttgacatgtattatggagatccaaggtgttccagatcggtatctgatcgagaagagctcacgaaagaaactgtttttcggtaagtcttgcagcagtgacaaggggagaaaaaataatgctcatgtatttttcactcggttttatttcccaaccccatctaaccttttcattccatatttcttgtatctacctacctccgacctgtgtaagattcaaatggtaatccgaagctcgtggtcaactccaagggcaagagacgaaagccgggttccaagaccttgagccatgcgctgaaatgcaacgatgtgctgtttttggactttatctccaagtgtctgatctgggacccagagaagcggatgaagccatgggagggactacagcatgagtggatctcggacgtgaaagcgcccgccaaacctgtgtacagcccatctccgtccgaaaccagctctggatcgcgacgcaaaagctctctgtaagtccgaggtttcgtctctccccgttgctgtcttggatttgtttgacgatcaatttagagatcgctaacccctggtttgctcatgttacgatcgatatagattctctggtcactcgtccaggaaatcaaagagcgaggtcgatgagcgcatggcactgaataacagccagttgtctagcagcaagtcgagtagggcagctgccaatggcaatggccatagcaatggcacgggctcgttgtcacattatgccaatcagggctttggtgggagcagctacggcgggacaagtcatatcgctaagatctatggcggtcaacagcagcagtaccagcttcctcaacatcagcaacagcaacagcaacagcaacagcagcagcagcagcaacagtactctcaccagcaacaacaacagcagcagcagcagccacaacagccagggtacacgaatggcgcttataccaattcgggatccacgcagtcgtcgtcgttgtctgcggcagcgtcgaggaggttgactgttggggatcttggcccgtcgtcctatcaacatgggtcgcggaagaatgcgacgagcatgtatgtatcatcttcgagcatcggtcgatcagagtactgagggaatggaggttggcaggcggagtgttatatgtgtgagtgaggtagaagacagtagcaatggtcatagcgatagtggtgatggtggccaatataccccgaacagtttgcagtgctgggcatgccaacttgtattgcagcgtggatgaatgaatagttgtgtgtggagtcgagtgtctgcacggatctctccgagcaggtgcacttttggtgttctttctgtggatctgcccacagaccggccattattttgtccaccgtgacagagcgcggtgaagtttaaaaaaagagagaaaaaaaaatgacgggcagtgggacctggcgacttcagtactgtgccgtactccagcactcgtactgcaaaagaggcagacggggctgagagtgtcgcgcggagaagtgtgaaaagcgatctcgcaagtgcctgtgacttgcccatggtgataattggatgcgatttttttttttttgctccaccgtgccaggttgcaaaaaaatcttattttcccgttccctcttccgccttggtgtttccccctttctcgtccacttccacttcttcctcttcctcttcttcttcttcttcttcctgctgctccttttgctcctttgacccactcccactcccaccactctccactcttcctcgttcaagcccagcgcaaccacccttccaccatgtctctcgccgccttctccgcaagactcttccccaccatgcgccaccaggctatggcccgcgtcgccgcacccgcctcatcctttgcccgtttctatggcagtacgtgtacttacttgctcatcccgatggcctgatcagtcgttgctgaaacctgtgcttctattccgagcgcaacaggacaaaaggattgtgggaagcagacggcaatggacacccaaacggacccgctgacgcgcaactttagcattggaaccagacaatttttttcttaaggaagcaggcagcggcaactggacccatatccgggaataaccacatttgattttttttctctctccttctggatgatctactgtcgctcgtcggcttcttttcttctttttttacttgcccgtgaacctgatattaacgttcgatcgggaccatcatggatcgcagcacagacaaaaaaaaaaaaaagaaaccctataattctggcctttcatcatgaaaagggtactttttgttcgcgtctttctaacttcattggccctttcccacgatgtcggttctagccaagcgcttcaccgcggagcacgagtgggtcgatattgagaacggcgttgccaccgtcggtatcaccgatcatgcccaggctgctctcggagagatcgtctttgtcgaggctgctgagctcaaggacattgagaagggcggtatgttgctgtctgttctctctcttgatgcaaaatgcgaatatgacgctaccaaagcaaaagcaaaacgatggcactttggtctaacctccatgtttttctacactctttgttgttcgaatggatagacaccatcggatccgtcgagtccgtcaaggctgcttcggacatctacgctcccttgtccggaaaggtcattgaggttaacagcgttttgggtgacgagcccggtctgttgaacactgcctgcgagaccgatggtaaaaaaaataatttgccatcccactatcgatgcttcttgtctgttgatctcacgctcacacacttgttcttttgctctttctttttacaaccttgtgtaggctggctctgcaagattcagctctcgaacgaggacgaggtcaaggatcttcttaccaaggaggcttatgccagcttctgcgaggagtctcattaagaaaaatgcaaccctatatagttttcccaccccctcttacgtctccctctctcttagtttttctttgctcttcattaaagacatcatcatcctgttcatgttcagctatcgtttcttctacttctcgcttgcttcttgtattttataggactacatatgttacatgacaacgcagtcgagacgatcacgctcgacaatccgctgaatactcttccagtccgatcgcatctctgcaaactcaaagacatcctcgacgcgcaagatgcctccgaaccgctccatgtcatggatcaactgcttcaggtccgagggggactggataatgaacagattgcccagttccttcagtgccagaaaattgggcgtcagcgtgggttgtttgaggctggcaataaagttgtagtaatggttgaggtcacagatcaacacgaatccgccctgggacgacacaatgttggaccgcaaatgcttcgtcaggcagttgaagagccgtagcccgacctcttgaaagaacacatcgagcgtgtgtttgtctgtgcatcccaccagcatctttgtgtgcgtcgtcagacacgtcacagcctctctgcatgcctgtcaggtcaagaaacgcaaaaaaaaaaaaaaaaaaaaagaggaacaaaaagaatagtgtgccgtgtgagtatgaagatcgcgttgatgttcgttttttttcccctacttttttttttttttttttttttttttttttttggttttacctgtgtcgcctgcaactcgatatccgtgttctcatctgggttataatccgtcgggagctgcatcgtctccaagatatattgaacctgtccgatcaagacctcaatacttttgtccagtcctgcagccacgccatcatcaatcatgcgctcaaacgccttcttttccttgttcgcctcgttcaagaaatccatcttgtcgatatgtttgcacatctcttctgcatagtagacctgcaccatctgcaagatcagatcggccacatggaccagttcaaagaaatccatcaacggcgtcactcctccgccatgggttgtcgtgggcttgtatcgacctaattgttggatcgcactgtccgatggcatgtttgcaaaaaaaaaaaggcaaaagaggtaatggcaggtgagcgataagtggagtgcgccaatgttcatcgagcggacctttacaccaattcaacagccgccatgctccttacgctgtaaatcctggtttgatgtgctgttgacccatggaccggagcagcgctatgaacaccaactcgatggtcttttgtctatagaacgtcgaatcatgcaaaagtgtgaaaagttcagcacaattgacaaccttattcacaagcgcccgacccacatacacacccaagagagggataatgcaaaatgacttacacgcgacctccgagaacaccgccaagaccggcgaatgccgacaaacgttggagcgcatccttgtccagatgaatcaagtgcagagccagctcaacactcagtagcgagttcatctcctcttgaacctcctgcgccgagatcatttggttagggtccactaccccggtattaggtgcactccggatgctcatgctgtccgcatcgctcgcaagcgacatggactttcgatctggcgcaaacacagatgtcgaggtggtggtgggtgtatcgggcgcggacgcagttgttggagaagtggtactggacccggtcagggacgtgatagatcgaatcgaaaaccgattgttgctcttgggaggagctgtggtgttgccagtcgaggcaggcgctgtcgcggcgctggatatagatgcagtggatgaggcagaagagggctgaataggggatgatactggtcccgaggtggaggcgggccgagaggacgtaggggccgatgaggtggaggatgtgacgccggcgacgatagacgacgagattttgtaggggagcgtcaacacggtccggaatccctttaaaaagtttctcttaaagacttctctgttcctgggattcatccgcttcgcctcgctgttgttattgccgtcacgctggaaaaagaggcaaggttgggtatgagaaatggatgttggatatgcacatcatgggcctcattctctaatttttctttcgtttccatacctgtcgttcgtgcttgtcgatctgatccttgcacgatttttgcacccagtccagctcctgcttcagatattgctccagccacggcgcaaagacccttgccaaaagtttctcgattcgatagtggggtagatggatcggctccatcttgatgagggtgtgttccaggtgctccaggtaccggtatgctgtcggtacggactttaggtacaacagcttgtctcgcatgctgcagagatcaaagagctgagagcaatattcggatatcacatcctcaaagacgcgctccgcaaagttgtacaacacgtcggcctcttctggaaacacgtcgtggatgatgactccttgcttttgaaactccatctctgtaaattccataaagagtttgagtggcgtgaattcagggaacgccatgttctcgcgtacatgtacgggttgtgacagccaaagctcgtattgcctatgaggagaggtggacgatgcagaaaatgggcgacaatcaaacgtgaaaagcaagacattgagcgtgagagccgattgttagtgtggtgagtgggctgttgaatgaaccatacttcaaagtttgacgcccatggtgtgcgtgttgcaaacagagagggcacatactttagattctcgcttggctcatagttattgtcgaaaaatatgccattcttctgaataaagatctggatgcatgcctgggcgccattgagatccaagagtactccggcaaatttctggtaacggagaacaggaacgggatagaaaaaaaaagtgtcagttgcttgagccttgataggtggcgaaaactgttgttgctgcaggctataccaactcctctgtgggtccacatgtctccttacagccatctctggtaaatcccgcgtgtcgtatgcgacctcgaacaaatgcagacaccgattttcgaaatactcgcatgtcccgtgaaggttctcgttgatctacagaatcacaatggcttcacacgttagtgggctgtttccccaacattatcccctggcgacaaaaagtttcctgaaaacaagaaaagtcgttcccagttgtacctgatcagagtcctcggcgagctgcgccttggaaaaggccaagagtcgggcgagcatccttgcaacatccaggacagactttccaaactcctgaatgaccttgctgtccttgttggactgacgaaagtcgacatagtagggccagagttcagtgtagatctgtctgaactgctcccttgctccgtgattcactcttctgccctggatcatggaatatgggtctcctggcaatcctgggatgtgtaagcgaggcttgactgctgtccccttttcagaatccagactagaccgcaatccatcgtcagagagtgtcgagagactggccctgccgtcgctcggtttggacgtcaaggccgaccctttgatcgcctcggatgtgtttgcagagatccgcttccgcgtcgtctcggatatgttggttccatggactggaaaccgcggaagagagtcgatcgggccatccagtaggctgccctccttctcctttgccttgctgctgttccctgtcccaaagccgaagcccatcaccaggagctttgattcccaaagttcatcactgtacacgatgaccttgagacgacggcaggactgggcgacggcgggcagggtggagacgggcaggtactggagacatttgagcaggagatctggcggcaggatggggatggacgttgcggcaataaagtcggttgaagaccggccgtcaaagtcatcgacgtcaaagacaagctccatgtcgcaatctcctatgcgcggcgcgttctgtgtttgctccgcactcgctgctctccgggtaatgcctgcgtggggagaggacgaggagattgcaagcgctgttgtccttttgggctgcgacgggcaaagatggacagctggacagcagactgcgtgctggaccgaggtggagttgaggcgtgatgagagcgaaagagcgagcgaaggtgctgatgcggcacgaggagaggagaagcgcgacgactgattagcgacgagcgaggacaagcatctggcagagcagagcagagcacacgacgaatgaacgacgtggagtgtaagataaaaaagagtaagggggacagaggggaccaggagtggtcaaaaagccatacatatctttcggctggccgcaccacccctcaaaattgcctgtgtctgcctgtcccaccatcccaacctgactcgacggaacaacatagcagccgatccccgcactgcacacaaggcgttgcgcaccatgctgctctggtctgttcatgcactgtttgctgctgaccccctactcagcgtctatacccttcctccgcgcctgaacggagctcgacaacacatcgctcgctctttcggaagcgcatcgcaaaaacgatcttcagcacgctttcatacagcaagtggcaaacacctatcactgtcgtgttacagatgacaaaagtgagcatgccagcgtgttgggcaatcatcacaaacgcggtcggtcgtgggatgaaaaggcaaaaacttgaaagctattgcaagatcaaagctgaaaatgcaaaaaaatgagaccgtgccgagggtcgaactcgggttacaggattcaaagtcctgggtactggaccactatactacacagtcattaaatcatgatgacgtcagagatttgacgggagcatattaaacacgcgggcatccaggagcgactcgtccaatctgtccgattcctccgaatccccggcgattccttgcgaatgagctgtattgtcctcgtttctatttgccacggaaggaatgaaagctagaaggaaacagacaaaagaacggcttagtaagatgaattgaaggaatgcgactttctcatagatttcgtggcagtgatcagcgagacagcttcgacatcaagtgtgatctcagatgggaatagtaggagaaggaacgagagaggcgatatgtttgagtcaccctcttaccatgctaccggggactgaagagagatcagatcgatatgcaaggcgtgcagcgaggctcacaagatgaggcccgtgggtttcacgatcagaggcgttgtcgttgtcgtcgcagtgtcaaggtcgtagatgatattctggtcgatgaagaagaaaggaggcgagggcgtgccacaatcgtcgagagaagacaaacaagacaaagcaatgtgcgtcattgaatagggagagcggagcacgatccagctgcaggtgtttacgcaagcaaccttattgaaataccttgggcggcaaaaaaaagtgatgtccttttggcccttcgcacccctcgctttagtgcagcacaaaaaaaacgagtccgtgacatgatagtacaggcgcagtcagatggggatgagtgtctcattggaaagctgaatctctcggttcgttttcctcccaagagtaaaccagtccaatataattagcagcctaagcgaatgagagcgggtggggagttgaacgatcgaaccttcatacgtgccattcaactttttttttttgtatataccttatgaattcaagcagaatgagagatgtctctttttcgggccatggttgcacaacatcctgcagctcagaaatttcagcagcaggtacgcgtttgtagcctagcagcgtggtacccattcgcgtatcttttgtgaatggcctctctaggaaacgaaagacatactggtatcaattgagcgcccacgaagggaggcgagggaagccaaaaaaaacaagtgatgacaacgaaatgaaaaaagaaaactatagaaccggaggtcgaaaagctgtgtaaggttggatgctgagaaggcaagaccccccttttcgggcagtcgtgtagccgttttctgggtgcctctctgtctctttgacttgtctgctaaacggaaaagtcgccccgagtccgcaactgatttttttttgatgatttttttttttggctttcttttcatcttgcactgttctgtcctttgttctgttttctgttttcgtttcttctctctcttcattatcctttcttctaattccttcgctgtcccttttgtgctccctgcatcgttttgttgtccctccatcccctcctctctatccctccctcgctcttcctcgcaccttcccttgcgttctctttgccgttctctatttttctttgtttgtttcattgccgtcattttgtttccctttccgttgttccaagtgttgtttgctcaaaagctgttcgcgcaccttcgttttgagttttttttcggtcgctgcctgtccaccccttcgtttccgctccaccccttatgtgcatgcactacatagattgtcatactcgcttgttttgtaatagtttctttttttgcctgctgttttatacagttgcacgcctagctgtttaagacacggtcaagcatcctcctcttctttcgtgcttcctctctatcattctctaatgcaacaaagcaggggcagaggcttgagccaggaatcatcttctaataacactggtgaagacgatgtcgagaacgacgaaagagcggctcaagcagatcaagtggatctagcgatcacagcgcaccgtcagtgggcctctgatccagctcaggaaccacctccgagccaaagtttgcatccacaaatgctctcgtcctccgatccacagcgatacgcttccgcgctttatcgccagttctctgacaaccgtcatcgttcccaataccctcagcagcagcagcagcagcagcaacagcaacagctctcgtataccccgccgcacgaatactactccaatcagcattattctcatcacccccagcatcatgaagaacatcagcgacatgcacagttctacccatcgcaacagcatcctacccctcttcaagatcggcgcttaggatccgcgtatccgtggcagcaagatcagatgagctcacatcccgttcatgccgccgctacaccgtacactcagggaagggcgattgaagagcagcatcgttatcagcagtctcaacaataccagaattatcagcagcaacatcaggggcatcagtctcggcatcaccagcatcaacctttacagcaatatgaaggccaacatcagccttgggagaacgaggatagccaaggagcgcaggggcgacttcaaaggggcagctctctgcatgatgctcatgatgtctttgttccgattcagcagggacaacctctggccgggcatgaatggccgtcgactagacaactgcaaccgatcctcgcagcgcccgtgcagagtgtgccatcgccatcatcacttgctgcaccgcactcttccctgcagtcacacgcgcccccttattctttgtcttcatattccgcctcgctctcgtcttcctcctcacccactctccctttatcctctgccacccttgcctcaacagcctcatcgcacttctcctcacagctttcgcaaacaagttatgcagggaatcgcctccttgcatcgcattcgctacccacgctcctatcgttctctgcaccgtctaataccaccccagcatcctccggccagtctttccagcgcccagagcccatctcacggcggaagagaggacgctcgagctattctgctgtcctagggtccagcgccagggaccgcagcgaggagacgtcggctcccttctcgaccgcaggccactacactccacagtttctcacttcaccttcccgaccggcacccaactcgggtgtaggtcaagtccatggtgcatccaccttctctgctcaccaagtatcctcagagcggcctcagcatggatatcccgcccaccccgctaatgattccaaacccacagcacctcgccggcgagattcgtcacccaaggaggatgcctcaaacaagcgacctctcgttctgtcgcctgatgttgtcatgtactctgaacagttcctcgagcccagacgtcagcgagaggcactggcgcgtcgcgacagccttccgctgcagcaccaagatcagcaacagcagcggttttttccacacgacatgcaacaaccagaggctgcccaaatatccagcgccttaacctctataaccagctccaagtcaatgctccctatgcctcatttccgaacacagctgaggcagcactctggagacagcaactaccaacggcgcttctactccagttcaccatcgacatcttcctcaaaacttccaacttcacaacctacactgtcgagttccccgtccccgtcacctgcatcctctgttcacagaggcactgctgccaggcgacagcactcaagcagcccagtagctagttcgcctgacgcatctgtagcagttaacacccagcttggtcggcttttgatctcgacaaagcagcatgtctcggacctactcgaatccttcatttttcccaaggacgatagaggtaagacgcagactcaaaacataccaagttgtctgttctacgcaaggtacctcgtcagtatacatgttctaacagcctctgtgatcgatagacgtcaaagggatgaatcccaatctggagggtgtcctagtggacctactcaatgggatgctgcagtctcatgatgcgtttgcgacacgcgacaacctgtcttctcaggaacagcccatgagcttccgcccgacagttatcgcctcactggcgcaatttagagaccttctgagccactcgagccatccaaggcatcctgcttcatcttttgctagcacagcaaagaccatgactgaagcttcctctccacttatcgttgctggtcaacgacaacactcactcttgtcctcgcgatactcctcaacatttctggaagtcatggatgtagaatcggacactgaaagataccgcgacgcgtcaggagctcctggtttgcccgataatgagagtcatgttcagggacagcaaaccacggacggcaacgagtctattgaaatgtacaagtccacagttgaatttttagcgctgatgacggcctttgtgagtgttgtgtgctggctcatgcagactcgcttaggcgacgccgatacctcgaaacccaacttgcagtctgaagctggcattcaagtgcaagcgcgtctcgctgggatgacggacattgacatgggaggaccagatggcggccgtcagaagagtgacaatacccatggcagcatcacattgtcagcattcttggacttgttcagcgatcgggataatgtcctgaagccgatcagggacgcgattacgaggtctatccctaggagaacgacagaatacatccacagtgagtctggcggtccggaccaagaagtcggactctttgcatggcactatcttcttttcggctcaaatcacgatgggccgctacaaatggatggttcctctattgacgcggatgcgatgcgttcggtccatttcgatgtgctcctaaatgagctctataccacacacgtcctgtctatgaccgtcaaagaacatcaaaaggaccacggccaattctatacgcccccaggaatagtggacttcatgtggaaaaggactctcagggaaggcgaggacctcttgggaacgctgatggccgtatcgagcagcaccgaggaaggcaaagatccacgtcgggattatacgacagagcacctcataccgtcggcgttggacccatgcttgggcgtctcgacatttttgtcctgttatatacgtctattgatccaggaggcgcagaaaggatccgctatggaggctatctggaactcagagttgggctcgaagctgctactctgccaaatatgtgagcacgtttggggtattgaactagacgggtttgctttctggatggcccggtgcggcatccttgcagcactgatgcctttggttcagcgtgttcaggagctttctcgagatggtgactcctctgctcttcaaggagaacgcctgcgcccgctttcaaaactccctcggctgcatcttttcagaagcgacactttacaactggttgtgccgaaaggaaacactccggaaatcgaatgggaacgccaatgcattttgaaactaagagatccaaaaaggcttcagtttgactacattgtcaccaatccgccatatatgattcgcaagaccggcacattcagtactcccgatgcagaggtgtttgattggactacattggactcgatcatcgctttggacgaaggagccgccatcgtaaatgatatcagtactactgccggcgtgagaaccaaacggcggaccagaaaggcagccctgagaccttcgagtggcgtggagggagaggaaatcatggacgtggcagtcaacattgatgacgaggaagccgggaatgagtccgatgctgagatcgggctgtcagagtcaggcaccagcacaccatcggcgacttcgcgatcaggaagggtgttcccgcccatgagaccgggcgcaaaaggcatgatgcaagcatacgggtactttatatggtttggtgcccagaggatcaagccgcattatggagttgtgtgcatgattacaggtgagtcgcgttgtagccatcatgagtgaaggtatctactgagttggcacagcgtaactcatttccctgtattccctctatttttgcaatgcctttagcgagtcaatggttgacactagagtttgcggcgaggattaggtaagtccgtgtgcaacgatcgcggattggcattgctgcccttgcagttcgattgctaacctctcctggtgtcctctagagcttggctgttcaaccactgcttgatggaagagttttttcagtttgagcccttcaaggtcttttccaaggtgcagacggattcactcatctttaagattcgtgccctaggatcgcagcagcccgatacggctcaagcgcacagaacggtctttcttcgtcatatggaccaccacaaaccacttgcaggcatcctgcaggactatttggactttttagctgcaggctcatcagcaccctcacagagtgagctcagtctcaacatcatggtttcgagcaagacccgagcagagcttcaggcagccattctccgtgagataactctgccgcaaacagtcgggagctccgcatcgtcagcctctgccagcaacgcgttgccactcacctactcgtttgcacccatgatgccatcgtcagaattgacgacgcaccttctggcgctcacgcgggaccttggagggatctgctctgcaggaaccaagaggattaatcggctcagtgcagccgagccattgctctggcaccgcggacccaacacaaaccccgtctatggactagtcgtccgtatggagtacgcgcgctcggaatttggggaggtcatgtctcaaagatggttcagaccggcgttttattggaatggaaagaactcgcccgagggagctagcgcggctgcagccattgcctctggcagcaaggcgatacataaggaaggtgccttttggcaggggcgggaccgactgagattgagtaagaaggaagggtcgccagcagagtcctatcttgtgagcgttcccgatgtgcagaggacgtatgggctctgtatggtggataaggaggcagtcaaggtgctgagggagcaggtcgaacaaggcgtcgaaggctcacacgcgctgtggaactatctgacggatgtgcgaagccattttcagcctggactcgccatgaagaagaggaagacggccggcgccagtgggaagcagccgtcggtggacgacgatggggtcgcgttttgctcaaccaaccagtgcgggtaatgcattactcggtctttttcatttgttatttcgcaaagctttcatacatgtatctaaccttttcctgatctcgctccctcaatcgcatcattgttctctttgcgctgccgcttcgctctcgcttgctctctctgtctgcgtgtccacatcacttgcgcactgcagctttgatgtgccggaaaagattattcatccgatcaattatggctacttttcaaagacccagccccgccaacgctttttcctcgacacgtcctcgttggcggttacgaaccagtgcatctacctgactctcaacaggatgtcgcatcactacaacgagcagcaaagcccgccccttctttactttctcacactgctcaattcgagtacattgcagttcttcgtcctccatcactgtcagtatgaccagcaaggacggatgcgtctctttcgcgactctatggccaaaataccgtttcaggatcgagatgtgaagcaccatccagagaagacacggtacgctgctcatttaggagagctcatgatctctttgaaggaggccctctaccgactcgtgtcaaactggcaactcacgagctcgcagcatgggttcggtagagctgcggcagcagaatctacagatggagctcttaatcagcccgctgcaaactctggatttttcagcggtagtcaaggtcttctggactgggtgcgacgaggaggtgatgcacctgcaggtgtgctaatgcgaactaggcaacaaatccagaggatgctcctgagcgtcagtgcgcagacgcagccgtgcgcagacacggacatggagagtgttgcgatagcggatactgagcgcggaatgcttttggggacggcaggaagccttagcgtgggctcaagttaccaggatcctcgtagtccaacactggtatcccagactgtagtggaaaggatggcccgcgagtgcgatacgattatgcaggcgatagagcgagcgattgagatggtggaggggttgcagtgggcagtagaccagtacggctacatgctctatggcattctgccaaagttccagaaactgcttgagatggagctcaaggttgtgtacagctcaaggctcgagtcctggatcgtccccacatctccttcggcacagtcgtcctccgccgcctttgcatcgcccacttccacagtagcgacagctacttctttaggccaatcgttaacggattcagtggagcctgacgacacctttatacgactgcagcggtgggacggtgatactagcgcagccgggaacgatgcaggatcggcaggatccattccggtgtatgcacaacccctccttgccagagcgcagtcgtccatccaaactctgcacaatctgcttcaggcatatccctcgttctcacaataaaacaggcaccatcgctcgctgttacactgctggttgctatcactgccgccaaaaatagaggagaaaaatggggagatccacatctagtggtccgaaccatgagcggccaccatgattatcccctatcttttgttcccgtttgatgtctgcgcgttggatcgtaaaaattttaggatttgctgtgttccactttgggttacacagactttgcaaatgcctacgtgcctgtgacgcacgcgactttacattctttcgtggattgccaagatgtcagtgaagataccatctcgtaaagcaccatctacttcttcagaaagctttcgttgtcattgtagcagccttagtgggtttagcgctgtctctgcagttatgcagttgccacgggttccatgctcgcacgctagagcccaaaaaaaagttggctcagactcacccttagcctggaatgcctctcattcttctctggcaacctgggggaccgagacacagagcgggtacgtcagggtgtctgtctctggccagtttcgtctttttcctgcgcgcgtcaaaagtgatggaatcagcgaggcgccagagtagaagataaaaaaaaaaaaaaaaaaaaaaagggttacagtcctcacgaaacggtctcaaaaaacgctctccattgtttgttttttaaaatattaacgttttcctctctattcctggacgccctctacataccatggtttggtgccatcgtgccattcatccctttaggccccgttgagaaaccaactccttgtcatcctccacgcatcgcccgacttcagcagcaattgtgtccgcatccgtgtccgctctccaacatagcatctctccgctctcccctcccccctccccccgccccctggtacccccttgctgtcgttggccacaaacgccgctttgacgacaccgccagagcacatcactcgagcacggcatggcccagtcacaccctggacaacaccatgcgagtgcgtacagccatcgcgctacttcaccaaccctaccatcgcagtcagcgcaatgtgcagctgtaatttcacagacagaaccgcaacagcggagcaagaaccatcatctgagtctgcgacctcttctgctcctcggcgcattgctcgtcgccctgcagtgtgccctcctcagaacacaggctgccacctatgaagtgcccgtctacaaacaagcacctccattagaaacccacaccaacagccccgaaccatccgtggacgcaggaaagctcacttcttcgaaatatatcggcaactccatcgtctcaaactccaaaaacttggggtatgcagggaccatcattcttggcaacccgccccagtccttcaaggtcgtctttgacactggcagcaacatggtcgttgtcacctctaacgaatgtcagggtgcccactgcgatgcagtgagccaatacacctgctactcctgcactaatacgcaacggtcctataatatcacctatggtgacggcagctggggtcatgggcctattgtcgcagacactgtatcgatcggcggtcttgtcatccagaaccagcagattctggacctcaccacaagtggcatggatctgagctcgtacggcccaggcgtctcgggacttgttggtctgatgtcggcgtctgaaggaacggtcaccccgccgatagccaccattctcaaggagaagctattagacatgaatgtcttctcggtgtacttgaagccgaccctcaacccaaacgatggcggctcgtttctgttcggaggcatcgacaagacaaagtttgtgggcgaactgaatcagatccccatctcgacagcgcagggtgtccgagcaggaatgtggtctatagatgcggacgcagcctttattggtaaccaacccgtccctggctacacaaagtcgccttggctctttgacacgggaacgtcctacattggggtaccgaccgctttcgccgaggcgtttcatgccctgatccctgaagccgaatactcgaccgaggatcggtactatctcgttccatgcacaggagagcagacctttggagtgacgttcaacggcgtcaagtatgagatcccctatctggactatatcgcacgtgccacgggcggatcctcgcagtgtgcttcgctcgtcatgccgtccatgaactctgggttgtacatcttgggggacccatttttgaggcaggtttactcggtctacgactttacaccgggcgcgagacggattggcgtggccaaggtcaatgccaccgatcaagctctaggcgatgaagggctctcgggagatccggtacccggaggcgctgtcatttcacccgtcgagccgcctcaatcatctggacagagccggttcttgcacatggatccgcggtttgtgagcgctgttgcggtattagcagctctcgcgaccttaattgcatagagggtagcggcgagagtgaacaatgaagaaatatacaatcaagcgagacttctgaaagagagagagagagggaaaaaaaggaggttgggccttgggccttgggctcaggagtcaccgagtatttgggatatggagatggagggcaggagacggatgaacggagagggcggaaggggttcatctggtggggccaatttttttttttggtttctgtcacacgagcagcaatcagaccaatttcctcttcgaaaactgaacgattatatgtattgctttgacataaccgttgacactgcgatgcctctattctacagcgccttggatattactatatagtgcatgaaagcagacctgagttgcctaagcgcgattgcgctacagactttcctggtggctattctcggcatcatgcaccccagggaagttttaggtctattaggcacgctttatgtgcggttgtgcaaacaggttacttcgatgcagccgcacaacataagcctgagagatgaggagaaatgccgcggattggatccccaatttactatgtaagcgagcaacaatgccgggtgggcgttcacgtcaggactctacacagcgtagctttccaagtggaaggttttcattcttatcatgttccaatttttctttcactgaatctctcattgagcgaccaaccgcagacgagaagaatcctgtttcccaaaggttacgcagattatgcagacaagtttgttgaggtaagcacttgcatgggctgttaacgcgcgtcattggctcgatcgtgaggtgagagcctggggggatctgcatggtggtcacagcggttagatgtattcttttccctcgagtatttttttccgttgacagagacactgtgctgttgggggagtgacattgaacaaaagctcggcatcgtatgctgttgatgttatcatcgtgctgactcggctgtgggcacctttcccttgtacttgccatgctgtgtgagggtcatctctgttgttgatggaccacggcaaaatcctatagcatggatgcgccttctccttggtttggcagcggagagctagctgaggaagaaaagaaggggaaggcgttatcaccgatttcttgcggagtaagggacagcgcacgcactctttttcttgaagtgtaacggagacggaacggcacacacctctggagatccttgcacagagagacacgcgcctttggaacccgagggagagtaaaagatgtggttcgtttacgtacccttcagtaaatgagactgagcaaacgcacatgtcgcgcaaaaaggacgcaaagagggagacgacgggcatacaaacaaggcatgagaaagtcctggttgaagcatgatagctgtccattggtcgagtgggttgaagaagcgctgcacgatgggcacataacgacaggggcgtagtgcgacatgaaagagtcgcacaaacttgaatatggtttgtgaccatggataaacagcgacagcttcaaaaaggccactcaacggcccttaccagtttcttcctttccattttttttttattttgctcggccagacccttttacatgctggtcgcttctatcccacggaccttttcgtttacttttttttttaatttgcatcctttcgcccgtctaccacactcgctaacatacagacactaccagctctcccaggaaccacatgagcgtcatcttcccttacctctccacctgatcatttgactaaagggcccactgtctcccctctttcccacttcctccctcgctgcttgagcgatctctcacagtgcagggctccatcttcgtcagtgcttatattaaacaacagcgcctcgccactgccacaattcgctaccatctgtcctcatcgaaaaaaagcgtaagtctcctcgtaacaccgcccaggacatccagactattttccagcggcagcaaaagtcgaaaacatttcgttggtacatccgcatgccctctcaacatgacgcgagccaaaacagaaaaaaaacagtacaaaacgtccccgagcaaaacattagcggcatcggtagtccctctccccatcacaagtccaaaaggggcggtgcgaagtttgtggcaatgcttcgggagattcttgtgcaacccagctggtgtatacatgagagccctgaacgtttaaaaagtccaagcttcaaaagcaagtggtattcacagagtgatgaacaagaccggttggtggctcccacttctttttctcagtgtctgtgtgtttatcaccttgcccgttatgcttgtggtgcatgcgtgagagtgacatgagtgcgggaaaggagaaagaagatacggtgggcccaggagacacgaacctatggcccgaatgcgcacgcgaaggggatggtgtagcacaacaatccacacccttcttttttcgctctggtctatttttaccacctatgcccagcagatggtaggaagcaacggtcaaatggacaaaactccaaaagaaaatgcgctcgtcgggagctctctcttgagcgaccgtatataaaaaccgccacaatgaccctcagacacccgcggatttctacatttcctcctgcttgtggggcaatcgatacttcttcacccatctactacccgaacgctaacagcaatcgcttgatctacacccacagccactgccgttgaccctccggctcgcatcgattctccagcctcctcgtcctttgaagactacaggacaggatcactaggtaaggaaggcagtttcattgtgccacgagtctcatttttccctttcgtcacttcttaatcatccttcataattgcacagagccatcccttgcccttctgcccttctttttttacaatgcggcacttttatttttcaacagtcaagggtcttgcgccgtgtgccttcagaggccactaaattcgatttaggcaaccattagtctactgagatattgcgatgatgacatgacgccacagcttcaatttccaatcctccctcatatacctcgtcagcatgtggccccagctcccaacacaaacaattccctatccgggctcgatttgctggttttttgtgcaacacgggcacttgttacctgcatccattccgggtttccaaacacacccagttcatatcaagcatatggccgtgacagcacggttacgtttgttctttacgcctgtcatatgcaaagcgccattgttctttgtgatccgttctgcactgcgttcctttgcttgggccatggagtacctctggtgccctgggtgcaattctttgtgcatctgcatggtgtggtagttatccagtcatctttctcttaacggtgcaggtgcaggaatgctccgagcacggtgcgagatttgagcagcggaggttacaaacgtatgaaaacacacccttcagttcaactaagcgctaggtgctctcacagttcttaggtgatcatgctccattactcatcattaggcatgtccctttctcataccgcttgattttttgtcgttggtatatgaatcacaacagccctcctcactttctctttcgttctcctgcccgccgtctcgcatcgttgtccttactcggaatccttcctcgcaccccttcttctcttgtagcttacacctgcaacaagacagcctctccccgacacacacctgcacttgaaaccaaggttcaaattcgacatgccttcgtttctcaagcgactgtcctccttcaccggaaaacgcctctcgtccaaacccagcaagcccagtgaccaccgctcatcttccaaaccaacgtcagtcgacgagacttattcgctgcccaaactccaacgctctcattctctcagcactgctattgacgcacataccgggaatggcgcaagcatgcagtgtgcagactcgaacagcagcacaaagtcctcgtcaagctctgcatcaccgacaatctccagttcatctctctcattatccttgccagactccccagcgtccgtgtcctcttatgctccctcacgtcaacaaagtgccgaaggcatgaacggagcttacgacacacaaagcagcaacaacagcaacagcaatatgcagcaaagaagtcatggcgctcaacgcgctcacaatagcatagaacctttccatccttccacaccttcgcctcctccatcagccacacaacccactgagagaggcacgtcaagtccaagctcagcctcgatctcagccccagaaacgacagcagcgcgcaactcaactccagcgctctcggttctagcagaacctcgatcgagatcgatgcctacgctcccggaacacccatcgtcgcacgtccctacccagccatcgggtaccctgtctgatggccagcgagacagctccgaagacatgaacatcatcccagttcctcgcaggaggaacagctttgcactgttcacaacagcttctagccccgccaatccaaaatctgccccgccggcttcaaaggaaaagaagatgcgtcccatgtccatctccagtctcttttctttaaacaatcagttcggcaatgcgcgatcccgaccgccccagccgccaaaggcaacccgttgggccagcagaggtggcattggtaccaagaacgagatgctggtcgagctcgaaaccactggcgtgtttggtatgtgcctcactcacgaaaatcaatcgcgctttaaaagaatcgcagccgtgcatcgctgacctgtcatactaacactgattataatgatcatagttccatccaagggtcagcgcctccgagaagagtttgtgtaccagactgtaacccagtgtgcagatgagatccgtagtcgaggtgagcattctgccgataggcgttcaacactcccgtcgtctactttttaccacgacattaaccccttcaggtttactttatgtctcttacttgtttgtaggactggaccatcccaacattttttataatccggcgccaaagaaagtgatttcgtccatgatcgacctgatgacagaccagcagcgctgcaacttgtttgcgatacagtgcctccgaattgataccgttgccagcttgatgctcaacgtgctctcgcagatgtcgaatcctgttatcccgtactctgtcatggagcactatttccaacagggcctgcccaccgcgcgctccaactcgtccccctcctcccggaggcactctgctgtcctaaggatgggattggatgagcttccgttgtccatgctcgctggtctgcctgccatcccagccttgcccataatgaaccatatgtcgtctggaacaccttcgcacgcgacgattgcttgggcccgcatgaactttgatctcgcggccttcctaggtgccctgcccctcatgaacagggtcatcttgctaaaggtgttgcacgtctgtcacgaggttcttgagcaccagggcagcaaccggttgacgcttgcccgtgtagtcgcgcagattgccccagctttgttttcgactgtcttcgatcaaaagatgttggagaagatggtcggaggtacaaggcgattctcgattcattgcgacagtatcagttcatatgagggcaatttagccgagaaccatctcttgacggtcattcttgtgcggttcatatacctcaccgtgaacagtcgcagcaacagcacgagcagcagcccaaggatgccagcacagacgaatcaccatcaacagcgacgcaagagtagcccatctctgggtcgatcctccttccacagtggcagtagtgggccctatgataacaatggatatgacaacacaatgttccacaggagccaggaccatatgcagcaggaacaggatgcgtactacttgaacatggcgcggtctttccaagcgatggagatgcagcagaggcaccagcagcagtatgggcagtatacccagtgcgcgcaacccaggccacgaagacaacgactgagacatcattataacccggaagactgcatcccagaggtggagtacgcgcctcacttagagtccattcatcctctggatgcggtcaactccaacactgcatacactggatacactggagcccgtgtgtgagaattttacactgccgcagccgacgctggagaccgtccttcgcgattacgtctggcacgatcgcatgaatccagcagtcgctggcgtggctatttagacctcctatcacccagcttctccttcacccatccccactcttctctatacagttagctcgcatttttgttttacacactttttcataaaaaaaagcatcagaggatacccaacagatgcgatgtggtcccagcgctcaaattttgaaggctgagaaagaaaaaaaaaaaaaaaaaagagtaaacaaataggcgcctgaaaggcagtcgcttccttccaaaccacttactttaccattgcgctgtttcttctgctgtccgtctccttgcattgatccctcgccacagaccacccagcatcacctgcctaaagcaccccggtccagcagaaccaatctctattccttgagatcccacgcgcgcctgacccgcatcgtctcttcctcgcaccatgaccgccgttgtgcaagctacccccaccaaccttctggacacgttgatccgtcgatacctcaaggacgatctcgctgtcagggaatacgtgccgtttgtcctagacaccatcacccatcaccgtctgctgcacgacaagaatgatcagcctgccaccactgccaacgctgggcagcagtcaacacagcaccgcatctggagccagcgcttaagatcactgctcgagtcccagcacccgggtgcgcgctgggcaggagtgtgctttgtcagaatcacggctcagcagagtgcctccatgttcacagaccatgtcagaacctgggtcaccctcttggtcggcatgctgactgtaagcatattcctttctcaaacagcttgttgccgatccgatctttcacaacgcagacgatggactaataacgtcggtattgttttgctacctccttcgcgatagaaacccgaaagtaccgccactgtgggtgcgattatcaccactctgtccgagctgtttgccaaaaccgccaagagaccagacttgaaaagcgatgtcacgtcaaagtacctgcccgactttcacaatcacattctgaaccacaaggataagaaggagcttttggtgagtaccgatgcagtgggtgaacgcttaacggtcgggatagcttaatggcctcaagtctctaacaatgggttcttatcaccattttcgaccatagccaacgatctacaaggccctcacacagtctgtcaccttgttcccaaccacattccgtctggctgtcgacaaaactgaagcattgtgtgtcgcgtatatggatgggcagttcgatcttgagcccgagttggtcaacgccgctgcaacctgctttgcggctctgcatgctgcaggaggcaagaaccccaaccaccccacggagagaatcacaccctcagagcaatggcgtagcaatttgcaagagatcatcaaggctatgcaccgctgcttgaacgacctctacagcactgttgatgaaggtaaacaccatgttttttgtgatacttgaagggtgtctgctacacaacagacaggatcggccacacttttttttcgcgatagaagtctgacgcgttttcctcctctagataaagcggaccagactgagatggcaggacgaaacaagcacttgaacaatatgcccgcacccgcaggagactcagtcctgagataccctcaactgttcgggcgtttcgggagcctgtccaaggccctagtcgcctgtttgacctgcccaaccaaagaatctgttcacctgcctctcaacaacttggtggcacttttaaccaggatctacagtgtcaactcgaagacgcccatgtcagacgctcgtggcatcgaccatcaggagtactttatcttcatcgccggcatctcgtcccttcacctctctgccaatgaggttttgaagactcttctcgcatcagctcaggaccatttggtccgccacatgtctcacctggccaccatcgtcgtcaaatccattcgccattctgcaggttcgagcagcactgtccggagctcgacctattccattgtcgaggcttgtattcaggcatttggaatcccgttcgtcaacatggtccaggtgcctctgatggcagcgatcctcgaggacttgcgtatgccctccgccaggatcgtcaaccctctcgagatcggagctggaggcgccaaccccaacagccgcgccaacaaccacaccaactctgtgaagcacaaaggcggcgctggaaagaaccgtcggggaggcaacaatcaggccaatctttctagcttgaacccactggaggagattgtcagcgcacaggttttcacaggagccttgaacattctgtcgctggtcttgacaactgctggacccaacctgtcgcctcatgcacgcgccgctgccgatacgctgatcgtgacccaccttttgaacagccagcatcatgtgaatcctattgagcaggcagaaactcccttctattcgcccgcggtccgtgctcaactgtacaaggtgctcgtcgcatctgtgtcctctccaggcgagactcagtccagcctggtgcctttgagcgtgggcattttcaaggctggtctgaacgacacggaaaagtttgtgagggacaactgtaccacagccttgacgatttgtgatctggtcatgcacagcagattgccaccgatgcagcgtgcccggaccgtagcgcagcctctggccaagggagagaaacctgttcaggatgctggatcgactctctttggagcgtttgaaatcgcgagcggatctggcaagaccgctggtgctgatgatgatgatgatgaggaggaggatgaaggcgaggaagctgaacacgctcagagcgaggaaagcgaagacgaggatggagatgtcgatatgacggtggagccgccattgccttcaaaatcatctgcagcctccatgacggcctttaaggctgctggagtaatcgcgccacctcagtctgcggtccaggaggaaaagagtagcaccacaacagctattgttcacacggaggagaaggatcaatttggcggtgtggtggatcacgaagccacccagactgtagccacatccagcttggtctccaggacggcagataggcaggagactgccactgtcactgccaaagtcatcactgcgaccaccaccacgactacgacctcgacctcaacgactacaaaaaccgcacaggcatcaacattaacaagcggagctgggggtgatggtgatgacgatgacgacgacgctatcccagatattaacatggatgatgatgaggacgacgaggacatggacagcgactaaggattgagatatgcgctcaaagttgagcgtcaaaagagatcgttttcctcgtagaataaaattttgactatcacggcatgagcgcgtgaaccagtaattatgtattttcctgtttaaaagtacaagcgcctcccgtcatgtcaaagtctcgtctatattcagtaacaagatgctgcctatgctcttccgaggcgtggtcgattcgtcgatgaaggcactcggccacccgcgccactgctctgaccgcggccctggattccatggccaccgttagactgggttgaggttgacagctgaacaccggtacttcttgccgttgaaagtgaggacgtcgcaccgagggtattgttatcatcgacggctgcacctccgtaccggtgcctgcttcccgatgaagaatgccttgctgctgggttgggatgtgaagaatcagcggccgagctcgaagacgcgtttccaaggtgcttcttccgattggcggcaatggcggagacatgtgcctgggcggctgcaagagcggacgatgtatgttttttagcactcgtgccgcccccgcccccctggcgatcgacaggagtcgatgtcgtggatgacccggtagcgttgccctggttgtaaataagtgagtgccgacggttggcctcctccattgcctgttggtaagcagccctacgttcctgatgctctctgtcgcgtgcttcttcctgtgagcgtatgacagtagtggtagtggtggattccaggattagataggcgggtcagtgatcagcaaagtgcttttgatctgcaaacttgacataaaagttgtcgtcgcaagtcctataatcaaaactttgccagcgacgctgcaggtgccttacaatgttcagtccttcccatgcagggtcctgcaacaacttttgaatgtgctccgattgtgaaaggacccttatccacatgtccagtagcgtattcgtctcgtccgcggttttgtaaaacgtctatttttgaaaaaaaaaaaaaaaaaaaaaaaaaaaaaaaatagcacgcggtcagaatgagcatcggaaaccagcatgatttcgtttgcagagtgacactacatacctttagtttgtcccttgcttcagacatgctggtatcaatggcatccagggccttcagtaatagccgtgtctcctccagctctgactttgctgacgttgcctcagacgttgtccctggttctgcttgcgcatctgccagatcggaacgatccctctgttgctgttgctggtcctgctgcccagccacatgatcgccagcagccgggttgtaggatccacgttgatcaatgctgtatctcgtacgcttgttcagtcgactcggggtcctcagcccaaatggcatctctggttcggaggcgccttcagacaaggtcgagaaaagcccgttgccggaattctgataggccgagttgctcatggtgagactttagagaacgcgtgatggctcttgccgagggagagtaaaatgaggaagatggcgtatgtgcgtgtgggtggtgagtggtggttgctgttcccgccttttttttttttttttttttttgtccgcgcaaaaaagatggatttcaacaagagtgtctttagccagtccaagccctcttccagagtcgaatgtctcttcttcctgacctcctcgcttgtgtgttgtatccaaaaaaaatggaaatggagactggccgcttgcgtcgttcaactaccctaactggtccaatgggtgtcctgaccaaagagaaatgagtagattgagtgagtagcgaggagggcgaaaaaagggtgccttctcgcgcgcgtaaaaaaaaaaaaaaagtcgaaggaagtggcttacaccccatataattgagcaaaccctctctagttgactgccaagtgtagatagtatatatagcataaatatttgtggcttatttatatggagagatggccgagttggtctaaggcgccgcgttaaggccgcggtctattcgtaggcgtgggttcaaatcccactctcttcaattatcttttgcactatcaagcgagttttcacgattgctcttgatccgttttttgcttcagcgaccttgatccatccgcgacgaacagccgtcaggaaaaagataatctgacatacaatgtcagattaactattctgacagtacagtcagaataagagaattttggatattctgacatgcaaaaaaagatattctgacatgcctaaaagtcagaatagcaggataatctgacatgccttcagatggatgacggtgaaatggcttctttttgccttagccatgacggaagagatgggtatatgatgaggaattgttttcagactcgcagagccgttttctgtcgaatgagagggaaatgaagtagcaactcatgaaacgcgacatatgattaccctaggtctggcgttgggagtgagcggaggcggttttgtccatttctagcatcacaataatggtcgcactgatagctgctgccctttgcgcatcatgctcaagcaggaaagcaactgtctttgctgcattcttgcaccggttcatgcagtacgactcgtcttttctcttagcgtgcacatttgccagcgagaggcatccaaagcatgcacttatgagtatgatgaagcttgctttgtggaatgcatgctgatctcagaggcgaagctgccctcagaacggccacatcagctgcactgacaaaaaaatggtgcaggtactataaacttgactactaagagagccattcgtcagaaggatctggtaaccagtggatgtagtggtagtgtgatacataaactacatctcttcttggcaggtctgggcatttataactgacctgccatcgatggagaggtcctgaccaaggaaatatatattcggttctctctagtttttcctctacctcattccagttattcatctgtctatcatctgtctatcatacactagcttagccctctcctctgaatactctacgcattgctgaactaactttgcacgctggtactgtgggtagttgaggctttaaatagagcgagtaacgcacagtacttgggttgcgtccgtcagcccgaccgcacagctcgagccgtaaaaattatcgctcgagcggggcgagcgggcgacttgagctgcatcctaagtgaggcagagcggatcgcgcgcgtcaagccacccaagtctctcaaggtcaaggcaaccagcatctccagttgtctcttcctactaactcctaatcaacctcccactcctactcttcactcatttctactcactcctacctgccgaccgctctaccagtgccttcatcttgctcgcttactctcgctttttgccacacttgtgccatgaagctaattcttctcccgctctaggtctcatttactctgttcacttcagttctctcatttagacgcagacactgtccacagcatcccacactcctgcttttagcatgcagcactctcccgatgcttggcttctcctttagtgaataaagaatctttcctcatacataatagcatggcaccatatcctgacggtttgtttgttcttatcttgggacaaaagaaagagttgttcctcgcttaaggagaaaatcgattagtcgtacctgtgagcgaaaaaaagccaactcgtccaagttgtccctcacccaaggacgaaaaaccgattcgtcccctctacgtacatatatagaagaaaggagtcgttcgcctgtaagagaaaaaaagacaactcgtcgagttgtctattcacgtatgcacaagggaggagtcatttgaccatggaagggaaaaaaatagacaactttcaagttgtcgcctatggcaagaaaaaaggagacaactttcaagttgtcgcctatggtaggaaataaagagacaacttggcaagttgtcgcctatggtaggagattcagagacagcttggcaagttgtcgcccatgggaggaaaaaagagacaactttcaagttgtcgcatgtgggaggaaaaaaggagacaactttcaagttgtcgcctatggtaggaaattcagagacaacttggcccatgggaggaaaaaaagagacaactttcaagttgtcgcatatgggaggaaaaaaggagacaactttcaagttgtcgcttatggtaggaaataaagagacaacttggcaagttgtcgcctatgggaggacaaaaaaaatagagacaactagtcgagttgtccacttacgaatgcacagggaacaggtcgttcgcccatggagggtgaaaattacaaatcgtcgagctcagggacaaaaaatcgaattgtccacccacggtccctcactcaaggacaaaaaatggagttgttcacccacgcatgcacaaggaagggttcatttgcccaggagaggaaaaaaaggacaattcggcgagttgtccctagcttggatcgtggtaaagtaactgctggctggtctatatccttgaactcacactactctggctaacatcagtgcaaatactcagtagcaaagactcctttttttttttttttttgaaaagcatgtcagattatcttattttgagaaagatattttgacataccttggacaatcgtcatgtcagaatatcttttttcaggaaagataaactgacagacatgtcagaatatcccaaagcccaaaagatattctgacatcaaattcatgtcagaatatcttttttggcatgtcagaatatccaaaattcacttattctgacagtacagtcagaatagttaatctgacatccatgtcagattatcttcaccccagccgtcaagggtagagtagtcgaagacgcggcagtcaggggcgccttttttgatgtgagcaacatcttctgtagcgtgcaggtcgtgtggtcgtttgctgacctgagcacgtccaccccaaagcccgcctccctctgggaaatgggttccaaaaaacatgggctgtggccaaaaccctgttctgcctgtgcctatttttccgcctctttggtgtctctccattctttcatgcccacttccgctttgtctctgcttcaattcattcagctcaaccgctaacgcctggtcccccatcaaaacactcttggtcatggacagctttggtcaccagcgccattctccccaaagcacgcagtaccagcgactcgatactgcacccttcgaacacaacgactcctccaacaccatgaacgcgagtgggctcccgccacagcaccaaagcagctactcggatttgtcgtcgacgaacgtctctgtgcctctccagggccatcggggctatgtcagcaaccctccacagccttaccacaacgacagtaacgtctctggcaaccctgcaaaccaaaaacctttcgagaatccatatcatgatcaccgcgacgaagaagctttctcctctcagccgttgcacctcgaggggcagaccctcaaatcatcatctctgtactacaccacaccgcctggcaggccgcttgtgcttcaaaccctgaccacactctcaaccatcgtcttcacggtcctgccagtggtcatcaaagccggcaccgacgccacctggggtagctggtactcctggagggatgcctgtcgattcattgagcctttctgcagtggactcttacacatctggttcttttactcctcggatctgatgcgcccttggatacaacggacagtgtcccctgaagacgattctgcattctccctggacaaaggcggtatcctattggacgatcgaactcggcgcaatgagaaccacgacaatagcggcccctcccattacgcccgcaacagcccgccactaacagcagcaatggcagcagcagcacggaccagattggataacggcacactcaactttacgccgaatgtccgatcctcctttaaagagactacacgtttcaagtcattgctctcggccgtgtttatgtttttcctgattgtctacgtgaccggggctgcgatccacaccgcggcagcgttctttaagaatacgatagcgctgttcctggagcagcactctcaaggcattggactttcgacccacccgccgaccatgggcgatggccagctctccctgactctggctttgcaactgaaggaagggtacctgttgatccaagacgtttgggaacacactatctcgcattatctgtacgcttttggagcgctaggcatgtcttggtgcgaaatgattgcgtactcgagccagatccttcctaaaggtgtcaatcttgcccgcgtcggccatctcaagaggaacgtcttctcaacagaggcaaccactgtcaggagcagcaagcgacttgtcgttctatgggctgtggcgggtgtgctttacggcgggatcgtcgcgggtaagtcaagagggaggaatttaaaaagacaaaatgcaggaacgagaaggtcatgtttcatcgtaacttggattctcacatgctgtcgctcaatgtgtctaggcgtcgcttgccaatacccaaggggactctatgtcggtctcgcatatgtcgcctgcttattgctcgtcgtctcagcctacatcctgctcacgcccacccgtgggctgttctccctcggtcgccattacatcctgcagacttatctgatcggcggcgttgttgcggctgttgctatcgtcagttacatggccaaaaaccgtttcgatatgttgaccagtaatgacaagtcccacaatggctccgtccatcgaccatagactaggtctgccagcgggtcaggtccaacataaagagaaaaaaaataccctgcatacagatatttctggtatatacgattttttttttgtatcagccttgagaatgatcgaaagctatggaatgtcctcaaattcttccacgtagtgtcgttgttaaacgtgggaaaacaaaggtctattcctggcaagaggtcctggtcatccatgaaagccagggtcgcgtccatttcctggttgccactcgcccgtccagcacgtctgagacttcccatatcagtccctcgtttagttgaacatggtaccctctgggggctgaggaagcttcctgttgttgggcgaggccatctcactaaggacgcgagcaaacaatcgttggcacgttaatcaggattgtctaagaaggttgttgtgagacaatcacatatgaggatcctaaagcactatagggcaattaccggcgcaggtctgtcaaaacggtctcgagaccgtaatttctattccagttcctcaagcagttcaactttgaagagtcgacctagttcattcgaggcaaaggattcgtagacgtaagtaaacgctggtcaaatgatgatgttggtctatttttctgcgctgtggatccatcagagacttacctctccagtggtctggttcacgcaaggaaggttgacgcgcgacagaaatgataccgatgggggcatgtcagggtacgatggtccgcagtgaatcttgagactgtaaatcctgttctcatgaaccgtctatgtagcatttggggatttatgcaaatacaaagtaagcaagatatgaggtcagttaggagcgaacgagagtaagcgatgcggtagttgtcggacgctggcagaataaagatctttccaactgctttccagaagaggtcgtaagcaataaacgttccacccaatatcgctgttgtccataaacacccctcgcgatttcaagattcgcatagcatcgttcagacccaaggttggccgctcataaactactagcgtggctcccgagcaaccagtgcggcgcaaggagcccaacttgctttgtaagccatggctttgaggtcgtcccatattgtgtccactgtgttgtccgtggtacgaaacgccatcgaaataacatataaaaaaaagcagcgaggcaagagtcgagtcgacttacgtgtccaggtccgaggatggttccgttccagttgctcatcatgatgtcgtcgccatcggagagtccgtagctgcaggtgccatcgccaatgcccttctcgcccttctcgagctcttccatcaacttgaaattacggggaactagtacagaaagcaacgcacggttaaaaagctttcgcagtttgtatagatctcaagcctataccgagaaggtgcaatagttggtgatagatgtcgggtaaaaaagagatcaaaagagggccgacaaagggagcagtttcaacagcactcttctgcgtcgactggcaacgagttggatgaagccagctatccacgtcgagtaagtcgagtctggtcctttggccgtcctctcatttgcaaggcagtacgtcgagatcaaaggcatggtcttggccgggtcagaaggagagagggcgtgaggcagatagcaagacgagtcgcacgatgcttagactccatggttatccaatgctttctgttgtggcggctcaatgtgcctgaaagtgtgccgttgcatcctgcatggatcctcgccgttcgactgattctttgatcctaaacgattctaccagcagatctacagtcttggtaaaggagcaacacttactctttgccatggcggtcttgttgttagtgattgagtgtgggtgagggttggagtacaggtgatgaacgaagaggaaaacgagaaaagcgcgagaatctcgcactcacgcaccaataaaaattcggccaatgacgtgaggcgctcatagtgtctcgttgtgcgttcgtttgcccctccttcattcgctatacacgatacacctatacaggccacaaccgaggccaacaatctggctccagtatgtctcgtgctccccgtagtcccgatgagcttccatcactgttagaagagaaaaatatttaaatggaagtctgcccttacactcttgaccccgagggcatgaccaaagaactacagcactaggaaaggttgatatcgtcgggccatcgttcacgccatcgttcaagtttcgaacccctcgcgttctctacaacgtgcgatcgaactgcctcagaaagcatggaaactgcctgcacctatggaataccaggtctgaacctctgagccactgccgcggtctcaccaaacagacatatggtcgcatctgagagcgacggcaccaccgtttgatcgtgaaatatgaacgcatactgttttccgacgcagctgtgtgcgtcaaagtcgcgtttcgcttctggtgtccaaaatttagaaaacacccctcctgtaaggggatttcccttctgttctcaacgcacgctctggcgattttcttggtcatgatctgcggttgaagaagatggaaaaaaaaatccgtagtccaaacgaactgtcaatcaaaacgccacggtaggttgattgttggtcattagggatgagcaggtgtcaaaaacctcagtagccagtaaaaagtataaggtgtcatcccattcaacaggtcacttaggaacgaactggcgctacaatatctagcttttttaactattctcctgctccatccatccggtgcaggatgaagcgacagtaccgtctttccatgtctgtatctcgtggcccttgcgctactctcgcctcactagtcttccctcctttgaagcatctcctccaatgagtccagaacactatccgcccacacgatccttttggacatctcgttttccaaggattggacaaactgcctgcgctctgggatagttcggttgctaagcatcaccataaaagcaaattatgagtacacgtgctttcgaaaacagtggataaaaaagaatgcaatgttcagggtcactgtagccgagcgcttttccatccctaaactgtgttcgatcgatcgaacaacgagcacggccgtacagatgtcgctgtggtatctcgttaaacatactcgcgtttgctgtgaccattcatcgagctcaaggactgactctggacaaggtcgtatttgacatggatgggttgtttgcgcacggccaagcctacgtggctatgagtagggtgcggtccttggacgatttgttcttgtcggtttaaacagctgccatgaggcaaactcacagactagggctcgcccggtttggtgtattgacgatagacatgcaaggcaatgaaaaagtaacgatgtttatcatgtttactactgcgatctgcatgagattccaccattgcctccgatatgaatacgcaatctcatctacgcgagtgtgatcaaaatcatccatttcatgtgcaaaggtaaatgtacagtggcgattcttagcccttgaaggtaatgcgtagccgtcggtaccttccacgacctcgctgcattgtcgtgagccagctgttgatagtggtcgacaactgctgtagacttttgcgtcggtcgttgtcgttacgttggcttcgatcgtaccaaccgaggatttgatctgcgctagacaccaagctgtagtaggatgcgctttgtacgtgtattagtccttagtgctaagaatatgaagaagtagagctgataaatttttttagtcattgtccgtttgaacgagtgatcgaagtagcggcctcgtggaccatcaaatcgaaatccgtactcgggcatcatcttgatcagcggtgtccttgacacagcgagcaaatacagatgggcacagtagcatatcaacggcagccgaagggatagcgttaccaagatcaagcactgtatatgtattctgcaaaagcgaaatgtgaacacgaaggttgcgaatacagaatgagttctcgtagccacatcgtttatttggtgcgcaccacgcatgcatccatcagtccctagctccttgccatgtcctcgagcaaggactcgacttcgggcacatcggcaagatagaacttggcctcggtctgcttctgtcccactgtgcatgtaatcacatcttccacatcgggtcccacaatgctctcgtttccgagacaagagaacacagcctcgtccgtcttgccgtcacccacgcacaggataaagtccacggggccaacatccgcctgaatgtccttgagaatcgccttcacgcttgttgacttgtcaatgctgcttggtctcaattccagcgtcttgttacccaagataatggaaagggccatgtgggccaacagtttctccaagttgacctgcagctctgtagcctgccaggtgccaaactcaggatccgcctcacgatagtgccaggtcatgttgatctccttctcctcgatgaaacttcctggtgtgcgttccgtgtaatgcttgaagaggggtcgaatcgtttcgcgccagctggcgtccacctgatcgacagatcggaaccagccgttaccggcatccttgaccagcttggccggctcctgagcattggaggtgggcatctctgaccggatggctttgatggccttggccacaccctcagggtgcttgtagaagcagccgtgttcggccgaaagtccaacgccgcattcgccaaaccacgaatccaaatgcttcctgtcacgaccagagagaatgtagacgtatgtgttgggctgggctgcaagtgcctgcaggttgtggataatgtggctggcagggttggctatcgaggcgcgatagttgagaacatgctcagtcagatggacaaacaacaaccaacgcacacggcttgaggcactaggagcaacagctgatacataccaaattcgggaagcttgtgtgtggcggtcaaggtgccgtcataatcaaagaagacgacctttgccttggtcgagtgactgcgggcctgctgaacatgctggatggtcaacttgggcaaagccatgcggtggtcgaattcctcagaaacccttctcagctcattgacaaagctcagaccccagtaggcagccgtgtatttggtgacatatctaaagagcttctggtgattgctcttgcgcgtgtcctcgggcatagtaacggcctcgtaaatggcatctgcaagctcgcccgtgttccaagggttgacaataatggagcctgtacaaagatggattaaagtagagttaagtatggtggaacatcaaagtgtccttatcaagaaagtgataaagtgagcaactcttaccgttcaaactctgggcagctcctgcaaactcactcagaatcatcacaccgtggttttcctgttggcagcaaatgtactcgtagctcaccagattcattccatcgcgcgtgctggaaatcaagcagacatccgacactgcatagagggccaccagctcttcaaagttgaccgatttgtgcaaaaagtggataggctggaactcaatagtgccgtacatgccattgatgcggcccaccagctcattgaccactgctcgcaagttctggtattcctccacatcctgtcgagaggggacagcgacctgaacaaggacaaccttgccgatccactcgggatgctcggacaaaaagacttccagggcatgcagcttttgggggacacccttgatgtaatccagacggtcgacgccgacaatcagcttgacgcccttgaatttctcgcgcagggactgaatgcggttgatgaccgagggctccttgaggccctctgcaaacttctcggggtcgatgccaatggggaaggtgccgacgtgggcatagcgaccctcaaagtcgacgccgttgggcatggtggaaagaccgaggatgcgagtgcaggaagagaggaagtgacgcgcatagtcgtaggtgtggaagccaatcagatccgagttcaggaccccgagcaggatctctttgcgcacaggcagaatcctatggtgcgggaacgcatgtgggcgtgctggattagcgggcgatcagaggcacgataacagccagacatgataagaaagaggggaaaagaaggggtgggacaggaattgacgtcatagattcgactgctcatgggcctcagactgctgctcgagtcgaggataaggttgcatccaagcctgacgcttcgtgaaaaaagaaacgaacacagcggcagacagacctgctgggttgaatacgtgtgtgtgtgtatgtgtgttgtaatggcttgtgtgtagcagcgggcgattacagtgtggtaatttgataaaaggcggatgggaatgacgagagacgtatgcgcgttttgaatttacctgtagacctcactactggggaatggcgtatgcaagaagaatccaatcttgatattcttgacaggctgatcgctctcacgctggttgtggacctcttcccgcaaaagccggggcagcagcatgaggtggtaatcctgaacccagaccagatcgccatcgcgaacaatctccgtgatagcctttgcaaagagcgtgttggcctgctgatatgcaccccagtcctcttcgttgaacgagatctcaccaggatgatagtggaaaagtggccagaggatgctaaggattcatgtacaagaaaaaagaaacgcaggtagtaaaaagaaagtttttttttgttcgttagcaatcgtatcttctcgaagagcaaatgtctacagacacgctcgccccagctgtccggtagcacccataagaatgattcaaacctgttggaaaatccgttgtagtgcatgtcagcaatctcatcatcgataaagacgggcaagcaagagtgcttctcaagaagctctttctggacaagagcgcggtcctcctctgggatgttgattcctggccacccgatccacgtaaacttcatcatgcgcttgaggcccgagagcgcagagacaaggccaccagaggacatcttgtactggtaggtgccgtctgcatcctttgtgatcgtcacgggcagtcggttcgagaccaccagcaggcggaggtcgtcgttgttgctgtcgccgctgccgtctggctgctgcgattgggatccgacaagcgacattggactatatacagaagtgaatgaggagagagaggaagggaagggaagaaaaagagtgaaggacgaagtagggcgaggacgagcagacgaaggcaacaggaaggaaggaatgagctagggagtggaaagaagagaatgaggcgtggcggtgataaagggcaacttgccaaagaaaaaagtgacgtcttttcgctgtcatatctaaaggcggtcgagtccctgagttgcactttcccactcagatccgcctctcgatagcgcgtcggtgctttgcctgacagttcgctgcattgcctgacagttcgctgcacactctgatgtggatatgtcgttcctacgtttgctcttctatcatcgttccagggcacagagacgtactttatagtctgaataccgtatggagggagctaggttgtagctcatttactcgggtgccttgtcctctcacagcaacatcgtagctcaaaagatcaatcttccgattgatcatccgattctccatccattctcatgctcctgctccatcgcatcatctgagtggcaataggcactctccgttccactgcctcagtcgatgcaaggacactcatatgacacttcctttttttttacgcttcctgcagggcaagcatgtttttattgttaacaaagaccggtgtaaaaatacaggttctaatagcataaatgtttttgggtgggagtcaagggatcaagggacgtcgaattggctgtttttttgctatgggcatagcaggcttggctgactgatggggtggaaggtgaaatacgagaaggagttggtccggcggtactcggcatcctgttcgttctcattcggcttgatcaaggtcgtaatgatattgatccaagaggatagaaatagggaggaccatactctcctttctcatcaaacgcctcacatccacctgccagtttcgtccaacggcctcaacaaagactcttgatgacccaaggattcccggattgattttttgttttgaatgtctagtgtgctgaaatggagagagagagagcggccgaggcttttctttacagacgatcgcgggagtaggtcttggtgaagccctggttctccttgacggtcatcagcttgagctgggtctcctggtcaatgttcaaccaagggtgggggttgttcttgcggtcccaggtgacatccgggccacgggcaagacgggtaacgtaccaggctatgaggttgtcgaaaaaaaggacggtccgaggaatgggatgcgttagcgatatgtgcttgtgcctaaccgtgtcgccccgttgatgcggtctgtcgttctgttgggcgcaatttcccttccgatagcaataaaaatagaaaggggtgcagtgtaaaaaattttcgatccgggttattccttggcctcgacagcaaggaatggaaatttcaggaacgaagtatatcgtgcttggcccgatgcacaaacactctgagcacagacagtgctgtgcccaacaaagggtagcgttgaaaagaagtgagacctgatatggtacacagcagatcggtcgggcacagggaaggtcgaccacactgttgctgcgagagagttgctgaggatatcgagacgcaaaagagaaagcgcacaagggctgggagagactgagactgggtcgaggaaactagcttaccggcaccaccgcatgcaacgccgaggacagcgtagatgggaatgacctcgacacggaaccaggtctggaagaaggtgggagccttcttgacggcttgggaggcagcagacatgatgatgggagagtggagagttggagagggttggggagaaaacgaaagaaagaaaaaaaaaaaaaatggcagcgaaaacggtccactcgagctttatacaaagtgcggagaatgaatgtcaaagatagaaaaaaaaaaacttccaggtcctcgcagtcctcacgggcaatatggcaattggccgccactaccccagagaatgacatcgtgctcactccgaggaaggtgcctgcctgcctctccacttcgatgtcggtgagtgctgttggtgcgaggaatgcggttctgcctctttccctttgctcagtttcagtcatccacaacgtgcgtttacggcgatcgaatcagagtctcaatgattttggttgctccatagacacgtacacgtacgtgttcgaggtgatcaccacgatccggcaacaaagccggttctgtctgtcgcggttagaggaaagacacagactaggaactgtcaagtaacgagaacggagtgaagaaagatgtattcaatgtctcctgtggacgtgggcattaaaggacacgtccacactaatcttcgctaactaaaaatattaagggtaagtctatgctaggacggtcaatccggtacactgtcgacaacctgcggcgacggcatagcacaaagcaaccttgcattttttatccttgatgtccgtcctttctttggtctgagtaaagaagccagtgctcataagagggatcacagtcggtataaactttggtcatagctcctagaatgtacatctaaagcacgcgggggttctggggctgggtcaagagagcttaggtgagaattgtctgatcttactgcagaagaggccaccatgtatttatctacagtatctttgtgtgggtccgagcatggttgcgttccagtatcctactacggcttggcgcgctccttgtccttctctcttacgagtcggctcgaactcctgttacaataaggctgtaaggccttttttctttttgtggtcatcaagttgacataccgaaaaaaaaaaatcgccacaatggctggtctgtacctccacaaagtcgaatggatgttgaatgagtgtctgacgtgtagtcactttgtcccatactctattgaacacgttttccgtatcgtttgccctccttttcgtaaccaagagttacaattaattggtgcttggtccattgagaatcgtagtagcctccattggtgtttaaaagtacgagaataggaaacttcaatatcgttcatatatttgctcgaatttagcaagtaaggacacttctgagacgaaaagcagtgtatggaatctggcgagtgctccatttaggactggagttgaagaacacgagagagaagaaaagtgtctatggagatttggaagaattagacacgaatgatctggaatgacattttaggatgtcctatagtcgggttgagtgaggcgagttgctgccaaccaccaagcctagtattcaagtacttcggtcctaaaatgggccgttccatgtttcgatatgggcgagccaactggataaagtatcgaccaggctctgaagtactctcgacaaatatccaacgttcggcttcgtctttgggccgtgtatagatacaaacaggttggtctgatcgacagcttcgattatccgtgttgatgcccaaccacaacgatgacttcgttttttggatatagacagttccatcgttgttgttgatgacctgccataacttctgactgtagagcgtattactactgtctgtgacgactgggtccaggaccactgcggtagcagcaaacggtgaagaggcatcatcacaacatgtcagacgtcgatcggcagctccccatggaaagcgaaaggcaaactcataaacagcgtcagggaatattggatcggctacagtgcactttaaagtggtggccaacatgaagagcgcgagtgcaagtgatgagagagctgtcatcgttaaattgcaggaatacgaaactagccaaagacgttaggactttgaacggtatgtagagaggcgttaggtgatgtcctgtggtcagcgccactccttagttgcgataacagccacatgaccttacgaaagtctgatcgggcagtgcctgcaatggttctaacagtagttgttgtgagcgtcgtgagagctgttgggaatcgatggtcttgtagggtcggtcgggtgtgtttcggtgcgggacgctaagtagatgcgagctctttatacatgtacgtgaatacgatcgaaacgacagcacatcagggcaacacaatttcaagttgggcaggtataagaaagatcaagggcgcgccgagagaggggacagtcaaatgtgatcaagggcaaaataggaaaggatggtggataagaaggagtgctaaaaattgaggagagctggaaaaatgaggggactgaaaaacaagataaaaaaggtaggaggggggtgccaaaagaagaccggaaacattgtaaaaatgggaaggattagaagagagaaaaggagggttgtgcgagaggggcgcttgagcacgaatgccgaaaacgagatatatgtaggagttggggatatctgggcttgtgtggcagccaagcactttctataatccctaagcagcaaaatgagactacttcactgtcttttctactcgtcaacattgtacctactttacattcaagtgcaagccctagagcagatacaagaacgcggagtctttgtctgtccagagaaagacatctctgccacctactgtatgggtccaaaggactgtttgtatcagaacgatagcgattgcaacacattcattcaatgcacagtgaatccagacaaccgaagtggcactccctttgttgtccactgtccaccagatttcaagtggaacgatagggagaaagtgtgcaactttccacagtttgcaacttgcacgcactagtaacaaacttttaaaacacccaaacttttagcaatataatccatttactacagtacttactataggtgtgcgtttgtttttgaacatgatcctcacaagggaacttccagtgtttgctcatgtggtgctcttcttgatttgcaacaatttcgaccgaacaaactatcttcggtatccacacgatacgaatttctctgtcgtatacagtaatgaatcctccgaatatgaagtccattcatattgtcctttcaatggatattatcaaactttccaatttcactccgagaagaccacctcaccttcgcaagttttcctgcgagatggtagttggatcaatcgtccgcgtacaggcagagatacttgagaccgattcgacagaaaccacgctgaacttgtggcacagctcgatcgaacacaatgcagctcagggtctagctgaggcactgaagactaactcggtgtgacaatcattcaccgttaaggcttgataatttatgcaggccccttaagccgttactttatcaccatgcggcgggcgctttttccaagccagaaaggctttcttaactctggcgccccttgagacacatatctgcagaaaagaaataaaaagatgtcctttcgaataaatctgtgcagcatagtgcttaatctcagcagatcgacgcaacagagcgtctctactgcttacaatacaccgttgcttaaaagtcgtctgcaatggatttatctcttccaatatttgaaattaacattagcaggagcctcatgaagcctttccgctccacaagaccaccccgcgaagtatgattcaggacccggaggtctattggtattcaactaaaaatcggaaaggcggtaatagttgcgatctagtacggattctgactaagaggcgttcagccataatccagcggatgatagcttcgggctgttgcttgctcaagcaggctcaagtaccaattatccgaatgaaaatcggttgtgccggctgcaggtcccgggtcttttttttttttttttttgatggaagtcaagaaatgccaggactgtcaggcagatcagtcgccaaaacaaaaagatatgccagttggaattaggagtgagtgccccgaatgcacgacagaaattcttacttgaggtgagacgaatcttacacttgacgatcttgtcaaaaagggggagatcctctgtgatcctttttcgcctgttagtacagtccaaaaagattgtcgcatggtgaactggctactttcattttttttcagggatgcgtcagtgtgtctgaggaagaaagacttgatgtccccttagcctacttatgtataggcactggtttgcgcaaaacgaggagaccttacgcgatgcccaccgggacaacgctatgccgcgcatccccctacatgttcacgtatgtatatgatgcacagttgacaaaccgaatctcacgcccatccacgccatctttgccagaccatcaaacaggtgtttgagtccgcgtgtgtgcatgagagatggcctcaaaaacaataaaaaggcgtgggcgtgagattgctaccatcagtaatacaattgctaactgagtatgcaagtgcgagcgagggctctgctggtgctggtcccacgcaggacgaggggagccacgccgaatgccacgctgtgggtgagtaggcgggcaatcagccaggcaagcagacagcgccgacagacagggagggacagaaagtaggttttgcacgcaggagtatttaatatggaattgatgtccctgcccactaggcaacggggggtggagcagagcaaatgggccgctttcacatgccagcagcgtgcgggcactttggcaacacacaacacataaacatgacgttcttgttcccttggtctgtctccatcgtgccattgttgtcccactctgtgtctccactccgtcgttcctttgcagctgttttccctccaaatcccactctcgcttgactctctttgtccttctttcttgcatcccccctccttctcctctctcttctctctcttctctctcttgtctctcttctctctctcttctctctgcatagacctctccttcgtcacacctcgtctctcctctcctctttcttctctctctcttctctcctctttgtttccactccgcttgtttgtttgtctcgcccctccacgctgcactccatctccatcgcactgctccacagagtcccttgaatcctggagcatccttctgccgtcgacattgcgttcattcttcttgttcaattgatcctggctgtctaaatatatacattttctcgctctagtttcagcagtacgacaacaattcttcactgtcccgtgctccactcgcaggtgtcattgccgatcctcttttctccacacttgttttttttttttttttttttttcccctctcactctctctcttgtccatcggtttcctctttccctcctacaagcccacgcacgcgtacagaccacaacaacaaacacagctctccgctccaccacgatgaactctgccgagagaacaacttccggcctcctggagtactatcaggagcacatccagcaggtcaccgagctgcagcacctcgtccagcagcaataccctcctcagcaccccgaccacgatgccgccaccagctacctcaacgaccgcatcacccttttccgtttcctcaaaaaggccaactacgtcctgccagaagcctacaacctcgtcgaggccaacgtcgcctggaggataggatccaaatgcgatcgcatcacccccagagacctggaagacaacccgctctggctcaatggcctcgtccagctcagaggacaggatcgatatggacatcctctgatcaccatccgactgggcaagtacgtccccgcaccccagcaagaatattcggacgagggcgagctcgagggcgaggaaaaagaccgctttctggaatacaagcagtacatcatctttgtgctcgagtgcacgcgcaagctgctctgggagtccagccgtcgccagcccccagaggagcatgctctgcaggcaacgctgatcctggacctccagggagcttccgtctcggatctggaccaccagctgatcacatatacgattgagctgcttaagcaccgctatcctagttgcattgcccaaggtacagcctcttgttatgctcaccacctctttgtcttttttttgttgttgtgctcaacggccgaattgtcacaaccacagacatcaaaaaaacaacaaaattacggtcgacaggacggatgggtcaacgacaacacaaatgatgcatgcaggatacaccctcgttgcagggccatgcaggacttaaaaatagttcaggaggattggcccttccttgattttgatcgtccccactcgagtgtagacatgcgcacatgagtaacgtgcacgctaaccctccctgttgtctctttacggtactagtgtacgtgctcaactacagctgggtctttggcggaatctggcaaatgctgaagcgtgctcttccggaaactgcccgcgcacgggtctcctttccatcgtctgtcgatgagctccaggagcatttcgacctcgaagagctctcaactggtaagtctaaacaactgaaaaagagcgctaaaggagatgcgattcgatcgtacacgagaaaaaaaaataagggacaagcagttgactgaccattgttcctcatggcctgtgcagactttggtggactggatccctatcagtacgactcggagacatgcgaggcgttccactactttggctacccgatgctcacgcttcagccaggaacgccgacctcctcgctcagccgggtcaactcgtgcgactccatctattacgacgccagctcaaccactcctcatcatagcccaaaacttcgcccacacgagggcatcaacttcttgtcgatgacaccaatgatgcccatggcacccccatcttcgggccacaaccacaaccacgcacaccacaaccatcttgctgttgttcgccctgccactctcaggacccgctcaaactctgttcctttcatcgacctcaacagcactcatcctcacaccactaataataccaaaactactcccatcactaatactacaaagtcgattcccatgaaggcaccgctactgggtcactccaaatcgagtgctcacatcccctccttcatgatcacaccttcgatccagtcggatttacccacccagtacccactctcgcgcaaggatcggacatcgatcagccggctttcgggaagcgatcccaagaacccacgcggaggtttattctaccgcctaattctccggcccaactctattttcatgcgcattgcggcgactcagcagggcgctcgacgaaaggtggttcgggtggtcaagacctgtgcggataagatgctgcgcacggacatgaagacgctcatgtactgggtcatggccctgatcatgcttcgtggcgaggtctggcagctgattgcagcgactgctgtgaaggtgctgacggtcgttggcgagggagacgagcttttgctgtaagaaggggataaggaagaagaagaggttgcaggaaaaaagtagttcttggccccctcgcttgtaccatattacgtgtattctattcatatttgtctataaacattgctactctgccaaacacctctgcaagaatatgtggtcgctagtaattgaagtgcagagagaaacgaaatattcatacctcaacgaatgcgagaggcttacgagatgatggcgcgttgtacaggttcagcatcagcgcacttcaactgctcgcctccataaccacgcgatccatcgtgtgttcatctattgtcgatataggccccctcccccctccctcgccttgccttgcttgggcctatctccacctagctccttaccttgttgcgtgcttagaacgtcgacctgatatttcaggcaacaagcttccgttatatagctttgaaccccacgagaaaagtccccataaaagagccagcttcaaactaaaagctctgcagccagtaagggtccaaactatggggctgcaagcgccggtccacacgttttgctcaggcggtaggcccccgtgttcatgtcatcgtagtaagcgctatttctaccagagcgaagtttcaaggtgtatgaggaaaacgccctgttgacggcaaacgacgggcagacccatcatccacgatcaaacaggtagcgctgttgtgaacgaaaacctagacccgagcaaaataattttagaggccatgggtggggatgtcgtgcctcgaatatcgcacgggcgcacggactagttgtacattcagtcagagggtccgtgacatgaagggtatcaaaactatcctacgtccacttccacacgataagggctacggaattcacaacaaagaggccacgctgacggaaggcgtaagctagataaaaaacttcggcacacgcgcctgcatgcatcgacagtatgctattgtagccctagaaccttgccgggtccaacctgcgcgtgaagatggagtatacggttccgaaaaacaagtccatgtatctagttttttcatcctactctttagaatcgtggctaagttgcaaacgcctcaaggaggtggctgggctggtaaccaggtcagaactatgctcaaggatacatgcccgtccaacgccgatagagaattaggcgtcatttgatcttacacagactgacgaccctatgggtgctatttaacagcagagatgtgtgtgtccacaaacacacaatgttcagcggccctgaatctaacggggcctttaaagcggcaaacaaactctgacagagtttgtttcgaacctgcagaatgacctagcggccataagcgacatctatatctataagaaaagtctcaagttgtaaggtgctcggtcaaggttttacggtctgaaaaaatgtacaccgtctcctggaacattaactcgttgataccggtgaacagccctagcctgccatttaaccattaatgataaaatcgccttggtaaaactgaatatggcgattctcgaggctgtccgacagtatgacagcagcaacatcaggaatcgactgttggtcatcgactttttgtttcagctgtaaacgaaactgctgtttcctagtacacatgttagcctcgaagaagcggtgggcttgggattgtcctactgatgttccaggaaagcacgtgaggacaaaaaaaacgatacccgcgtttcttttcgaggctcttaaaagctcaaaaccgttcttctgcgctccattttcaatctcgcctccctccacagaacaacttgcctattcacacctctacatatcgcataccaaccacactcctcacagccatgaaggccaccctcctgcttaccagccttctgtccttggctgctctgtcccgggcagaaatatggcggtaataaaaagaataaagtctatgcttcagcaaccctgcatataaatgcgtcttttgtattgagcgttacagagttcaccatcctgatatctctcccaccatctcttcttttctctctctctctttctctcgtcgtctctcgttgtctctctttggctatgggaatcgtacacgggttttatcagcatccccctcagaaaggctgacatcacacccgcagagcagatgcaggcttatgccgaggcgggatcgtacatggctcaaaagtactttggaaagcaccgcaagttccagaaggaagatgccaccagaattcttgggttggatgctgaaggcaagcccgtttatggtgtccctctgagcaactacatgaacgctcaggtaagaaaagaaaatgaaaagaaaaaagctctctcgtgagttttgcacttcgcgtgagacggatcacccatttcacactactggcaacgcttgcgtgtattatatggcgaggagaaacactttggttggattggactgtgttccagaatgcgcgtgttccagctaaaaaagcagcgcgttgtataaggagctgagatcgcatgctgagtgagcaggattccatctcaccctaaaagaacgaattcggtggataaaaaacgaaggaaaagggtgctttttctcgctaacggttccgctccttgaaggtctcgctctcacttgcccttgaggagaaaaaaagagaacggaaaaaggcgtgtatcgaacatcacttgagagggagccgtgattggggtggggtgggggtgtgcagtgatattttgccttgggcgcatcactgacccttcttacactcttgctttttttcttcgtagtactatggcgaggtgaatattggaacaccaccgcagacattctcggtgatctttgacacgggttcgtccaacctttgggtcccttccacccattgcaactcaatcgcctgtctcttgcatcgaaagttcgattctgaaaagtcatcgaccttccgaccgaacgggactgaatttgcgatccagtacggaagtggatcccttgaggggatcatcagcaacgatgttctcgaggtcggcggcgctgtgatcaagaagcaggattttggagagtccgtcaaggagcccggattggcctttgcgttcggcaaatttgatggcatctttggtcttgggtacgacaccatctcggtcttgggggtcgtgccaccgttctacaaccttgtgaaccaaaagctcgtggaccagcccatctttgggttccacttggcacaggccggtggcaacagtggtgggcagatgacgctcgggggcgtggatccgaacctgtataagggagagatgcagtggcacaatgtccgacgaaaggcttactgggagattgatctctcagcggtgcaactcggggatcaaaagattgacctggaggcaggtgccatcattgacacaggaagctcgctgatagtgctgcagacgaccatggctgaaatgatcaacagagacattggtgccaagaagaactatgcgggtcagtacacgatcgagtgctcgaaggtgcccagcttgccagatttcacgttttttttcggagatcggggttacaccctcaagggctcggactatattcttgaagctggaggctcctgcgtgtcggggttcatgggcatggatttcccagagtcgtttggcgatgtttggattgttggagatgtgttcctgcgcaagtattatagtgtgtatgatcttggcaagaaccgtgttggttttgcacctgccagatagttagctactctatgccaggaaagggagagatgggatttcatgcttctaaaggaatacatgacgttttattctatgcagtgggggggaatatgtatgtagatgatgaaagattaaaatcatacgagacttgacagatgtaagaggaaagaggatgggaggggggatagggcgccgtcttgatttacagctccctgcgacgatctgcttcggaactgatgctgttgcgatggtggctcgttgttctttgtgagcttccgttttcgacacccgaggccgtcgcagaaagcgtgtccggtgtcgtggcaaaggtgtcaggcatgaccttgtccttctcagtctcctcagccatggtctccttggcagccgtcgtctcagcatcgggcaacgtatcctgagagtttccagcaccgtgctctgcatgctcgaggggatcacgacccttcagcttccggatcaagcgcacgagccaaggcgggagcacgccctcaccctgaggacccatccggaaggacatgacaggatcgcgctcatccttgttgggcggcacccagcgtccccctgacagcttctcgacaatgaacactgtgccgttgatgaccaccgcggccagcagacctcccaaaagaccataggcaatgttgtaggtcaagggcatcatggccaacgtcaggaacgcggggatagagtcgccaatgtaattaaagttgatctcggtcacagatttggtcatcagcgagccaacaaagatcaaggcggggccggtggcccaaggaggaatggccgaaaagatgggcgagaaaaagagcgagatgaagaagcagaatccagtcatgatggccgtgatgcctgtgcgtccaccctcggtgataccagcacccgactctacgaacgcagtgacgtccgaagtaccaaagacggcgcccaaggagacgcacaaagcatcggtgatgaaggcaggggtggagccctcaaagtcgcccgtcttggggtccatgaatccagcaaactgggccatcgagaacatggtgccggtggtgtccaggatgtcgacgtacaggaacgtgatcagcgccagccaaaactctcctgtgttcaactgaaagtccatgaccgcccatgtcttttggatcgtgtggaagctgacaacctgcttaaagtactcgaagcgactgtcgcctgtggggtcgtgggggaagtaggtcacggatgtgtttcggaaccaagagacgatggcaacaaagaggatcccgatcaagatggcgcccttgactcggaagaggaccaggatcgagatcataaagagaccaaggacacccatccatgtgcgaggagattccatcctgtgtgacaaacaagctcctgaggcatccaagaattccgagttgcagccgcccaagccgaccaaagttgcaggatcagcgcggatgagaccaatgccggcagaggactgcatgccgatgaagcacagatacagaccgataccgacaccggtagcgaccttgatgttgcgagggatggagcgagcgagccactgacggagtccaaggatggagaggaccaagaagatcagaccctcgataaagacggcagccaaagcgacctggtagctgatcttgccgcttccaaacttgccgacgactgtgtaggtgaaataagcattgatacccatactaatggtgttcgaatgagaccatgtgagtatgcagtaacacataaagcagcactgttgatccacaacaaaaatatgacataactagctcctttttttgcttaccctggtgccatgcccaaaggcaggttcgagaagaggccgatggcagtcgaggcaatgcaggccatggctgctgtggccacgatcagatccttcctgatgatgtccacgcaagccatgtactgcgcgttggtgctgcagtaggcgatcctgtccgcaccccctgtgttggggccagtggggcctccagcgacaccgcccttggtgggatcgaggggatcaaagtcgcagacgcaggttccgcccgtgtccgagataatgagcgagttgacggagatgatgtaggccatggtgacaaaggtggcgaagcccgcacggatctcggtcgagaagcgggtgttgggacgggcctttgggtgcgacgagccctcgagcatgaaccacctgccgacaggggactgtgcgacggcggtgttgaggcgggtgacaatgccggtcatgatagtgcttcctcttgtgcaaggagagagagagagagagagcgagagagagattggctgtcttcccaggagagggaagggacgagttctaacggacgaagaagcagtgagggaagcaagaggcaaaaaaaacgtatgaaaaaaaactttttctgtttacttgcacacctctctcggcacgtcgacgaacccagggcgagtcattgcaggggtttcacagttgctgtcgtctgcatacggggacagctatcggattagagcggggagtccagcgaacaggcacaggacggctattcttgcaggcgtcaagggcgcatggcgagagtgcggcagcggctgactgaacccaggatgtcagcgaagcggggatcggacgtccaactgtaaaagctcaccacgaatgtccgagagtgaagataggccggatatggaaggtggggagaaagggagaggcggccaggaatgaacatacgcggcaggtgcagcggaggcattcggccgcaaggagggcgcgtcgtgagacagagcaagattctgcgcagagagaggatcggcaagaggacgcgtccaggatggacagcggtgtgcaaaaaaaaaaaccagatctctggcggtggtatgaatattcattcaattgttctcacggacctgcaacttaagaggcagtttgtgcgcaggtgacccttcaaagacgcatcggtcgtctgcgcacaatgtcacctcattcctttctgcccattccccatactctagcatctcgttccctccaccctgcctcaacacccacacataccttcactctcacacacggtcttctcacaacacaccagagcaagctacagacatgattgcacttcccatcaactttggcaaatggatcgaggagcacaaggacaagctgcagcctccagtcaacaactaccttgtccagcgcggcgactttatcatcatggctgttggcggacccaacgcccgcacagactaccacgtcaacgagactgaggtaaacgctctggctgatgcagggtctgacattgtgacattgcagcctgctttggtttcgtactttgcacttttactaatgcccccagaccaaacacgaacgcaaaaaaaaaaaacaggaatggttttatcaatacaagggcgacatgctgctcaaggtcgtagacaatggcgagttcaacgacatccacatcaaagaaggagaaatgttcctgttgcctggtaagagacacggcaagagagagacgatagctcgatgagccggataaatctcgttttgctaggtcaaaaacgaaggaacttttcaatcaacgcgctaatcttgtatttcatatctccctgtttttcttcgaaaaatagccaacactccccataaccctgtccgctttgctgacacggtcggtatcgtcattgagcgccagcggcccgcagaagcccttggtaggttgtccttattttcttctgtttcctagttgaattgaggtgcttgttcatatattgcaaaaatgtgtgacgtgcaaaaattacggccttgagaatctccggacctctccacacgctgaccgttcccctctcgtcattcttattgttctattgcggcccgcttctttccttcttgcccctatactcgactgatccggcttgctatggaccagatcgactgcgctggtactgtgagcagtgcaaggagattgtctacgaagagtcgttccactgtgtcgatttgggaaagcagctcgcccccgtgatcaaccggtatgcggccgacatctcgctccgaaagtgtaaatcctgtggacacaccaacacagccaagtgagagtactagatcgtatgacacacacacgcacagagagagagagagagagtgaaagaggaagaaggggaaaagacctgcaacctagagtagacgcctcctaccaagagctagtaaaaaaaggagcaaaacggcgtgtgtagaaccgtttgtcagacaaacaaataaatgtctttgcgattcatgtggggaatttagaccgtgggagacgtgcatttgatacattagaccgaggcatcaacacccaaaggcacaacctgacaatatagcctcaacaacacgcctcggttactaggcgacactgtgacaaatgcagttgatattgtcgtcgtgacgtgacgagaccagccttgctagatttcgaacgcatacggaaaaagaagcgacgtgaagaactcaggggaggagggggaggaggggctgctgaaaaggagggctggccacgtcaggaagggaaaaaaaggggagcggggtcaacggaggacgcgttgcactcacggttgtggctaacctcacgatctcattgagtagaaaagagatcttggcgggtagatctgggtccaactttgagcgcacttttcatacctattgctcaaaggagaggatcgagtcttttctccttttctcccccgttgtggggcttattttgctgggaaaacaaaaacttgcttaagcaagcattggttctcgatagaagaatgagaggcggtaggagctgcttcgtgatggaagctgggcggtatagatttctcgggagaaatcgtccttccagcccgagcagtaacagctgaagaagctctggtagcgtgcgagaggccacaagcaaaggaggaggaggggtgggatgtgaaggaaaggggtgtggcggtagaggctcgagagagaggccaaaaaaaaaaaaaaaaaagtggcccgtcgggatgcaagaccatcgccagtaggagaaacaaggcaacgtgagctatcagggatcattcatccctggcctcgtccaacacgattgtcttttgggttgcagcatgcacgtacaggcagtagcagcggcgtgcgagcaagagtcgaaatgtgttgggcactgccttataaacttgaggtaggacgcgactttgtaagggtctcttgcatagacattgcataaaacgatagactacagccgccatgcgacaccctaccagccattagacgacgtgtgctgtttgcaccccgcaagaaaagaaatctacgctcaaagagctttcctatcgccttgcatgcgatgcgatgcggtgtgtgctcacatgtcatgtcctgcacagaacatacagctgcgaaagtggacgtctatgtatcaggcataaaaaaagctcagcatcattgctccttcgtcctcgtcctcctccttacatattctctgcgggaaggggggcctgttgagcgagcaggggggggaaggggtggaggggaaacgggaagagtaagccagctgacagacgcagtgctctcggaggatgactctctccatcgttgccgcatagggaaagagtcgaatactcttttcgggcatagggacaatcacaacggagcttgctgccatgcgagatggatggaaccatcgattgtctttttgcgatgcggctttttttttcgaatcccgctcgagtacatacacacgaagcttttttttattccttctgacctctccgtgatatgtttgtccgagtatgtacaagtataaactacgcgtaagatcaaggagtaaggaaaagagaaaggaagatgagccgtggtagtggtgttggtagtggtgttggtggtgcatgtggcatgcagagtttgaaagccctcgtgggcaagcaaaaaaaaaaaaaaaaagtccaccccccccctctcccttcccccctccccacaaaactctttttttctattcacatcaaataccgatttgcacctgaaatttcgagacacgatcctttctctacacacaccccctttttttttgtgagggcgaagaagggcatgattctcatcgggaagagatcgaacaacaaaaaaagtgagaaaaagtttttctctttggccacctcgtcaaacgtctgatttctctactacttggggtatggatccatgtacagcctctggaggcagtgggcagtgtcaccctgggttgcaaaagaaaagctgtaggtttgatctgcacgacgacgacagggcaaaggcagagaaaacacgcagtaaacaacgtgtagaaactcagacgaaaacccagcttgcaaaatatattccgaggcccccttattattacagacgatcattactgtaacgcgcgaaggggcgcgaagatgcaccccagcaagtctcacctttgcagtatctggaacacaagctggaggggcgccaataaaagaagaatatagacacgcgagcatcatcgatttcaatggtgcgagaagaaagagtttttattctacagcgccatgaagagatcattccatggcttttaaaagtacaaagagaagtgggggaggggcaggcgattatttacagggcctgtcgaccaaggatataaaaatacaagttgtagtcaaaggcgagagaagaaagatatgtatatacaagagacatcgctccctgtttgtcagtgggtttcgcgaaatacgataagccaggacatgaacgggaggaatggagtagggagatcaaccacaacaaacaacataagaagaaaaaaacgaatcacatcaagggggggggatccgcagtgctagcgtgagagagcacgcatgcttcagaaacgacacaggctcgtggtttttttacaagcgacgcgcacgtcgaccgtcggtcatcatgccacgcgagtgtgtctcggcataatgtctcgaccactggcccgactgctgagaacaccagccatcctgacgaatatcgcactgagcgatgcgcatcagggattgcttagcggtcaggggggacaaggacgacgacgacgcagaggacgaagcagagctcgggcgaggagccattgaatcagcgtcctcctcatcggcctcggcctccatagaggccatggtcacggtcgtctcggaaatacttggcaggaggtatgaggcacggcggtgttgctgctgctgctgctgctgttgttgctgcagctgcagagcgtggtgatgaccatgggcgttgttgttgctcttggacatgcctgcagctgcagagagggatctagacgcaggagacattgtcgacctttcattctccgacgagtgggaggaggaataggagatgtgacttgtccggcgagcttggttgttgtgctgtcgatccgatcccgacgccgaagaggccgagtacgacgacgaggacgaggtataggagggcgagccattggggtggacgcgcgccatggaggtcgacgtcgaggcaccagagccgtagtagatatgggtgttgtcgtatccgaccatcagatcgtcgtccatatactcaaagtgctgctgctgctttggctgattggcatggtttcgcaggctgggtcgcctggcctgttggcgattcaggctgttgctgcgcgagagcctcgtctgctggggctggtgctggtgctgctgatactgttgctgttgctgttggtgctgctgctgttgctgatacgaaagaggccgtctgggatgcgcctgctgataataaggcttttgcacctgcgagagcgactgggtcagcatggcagagtgcgaacgggaggacgacgtgatggaggaaggagacgagtttgtgggcgaggatgagagtgaggggggagtcgagtatgcgggcgaggacgcctgggtatggaggttgtgctgatagtgcgggttgaacgagtgccgatcctcgcaagggtagagctggtggatcgtttgctccttgcgcaaaagtgctggagaggcctcgctgtaggagcgtctgatgttgggctggctgtactcggggctgaagaagttctccttgtcgctgttggtgctctggggactgggagggctttggggaaggacgcggttgctgaggaaggagtagaagttgttgagtccgcccatggctatgtgtttgaaatcgatatgattcttctgcaacacgctgcgtgtggacgagtcggagctgggagagactgagaccgaggtggagaggcggaatggaggcacagaatggggaggatggcagaggagtgaagacggtcgcgtgtgtgagaatgtggaggtgtcgcggacagagagagcgagagtggagtgaagaagtgaaggacggcaaggacacgataaaaaggacggcaaggacacgataaaaaggacggcaaggacacgataaaaaggacgacaagatagatagacagagagaatggagaagaagcagaaacaatcagaacagcgaggtggtgctgtatatatctggcatatgattcgaaaatggggtttttggtgctcttcgattcaaacagaaagtactctactgcccgggcagaggggcacatcgcagccgacaaatcagcgcggcttcctgcctccctgcccaattcaatcgtcgccgggcggctattctattctcaaccgcctgtcgctgctggactcgccttcacacataccctctcacacgtacccttcgcaggccaaaagcgaaatatcgaccaaaacggcgcctctcctccctgaggccacccgtttgcattcatttcctcgcctgctggaagaacggcctaacgctccctctctaaacgaccaatagtgcgtctcaggagcgtctctagggccgcgatgaccgcgaggaccgcgagaatgatacacaggcaccttcatgtcctcctcaggtccgtcgaggacaacgaggccgggagtcgtgtgtcctgcatttatactttttgatcagacgatatgccatttttttggttatgctatccagcccagacagacgacagtcgatctccagtgcgcgtattctctatacctcaacacgcctctcgaattgagggagcgttggcagtcaggtcacgataagaggttttgatagtgttggggggtccgttgctgttgttgttcgcactgttcatatgcgagctgtcttgcttaagtctcctgtctttttgcttcggcttatcactgacgctgtccctaaacgagggtcatggcgcaggcagaggaaataaataggccaaacatcatcactcaccacactggacaggtgtgaaaagacgtctcgacccgcagaaaataggatggacccacacgcccggagggaagggtggtgagcgtgagcgttgcttttctggatcccactcacacccccacgtctccacgaaaagagatctcgtcaatcctcgccataaatcgccatggataggagcaaaggcacggggggtaaagcgatcagaaataatggagatcagcgcttttccggaagactcggatttattgtcacgtaaatctccattcatatctcggtgggcctaccccgagatggcggctctctttattacctgttgtcaaacagcctacggtcatgatagactatagccccacagggagcaaaacaacagcgcatgggagacatgaaccaaataataatcgtacactacctcatcatgagccgatgaaaggtgaaggccgatgattgcgatagcgatagagacccgcttgttaattctttttttttgttgtcgcttgatctgtttgttgatttgagaactgaagatcatggtcataaaaaatgacaaaggtgcaccgcatcaggagccacggtattttcctcggccaaacaaccgtccttctctctggctgacaagcacatgctttctgttcacctgtcacttgagcagtagaggtcttatgagaggaggtgctgctcggagccggagtcttcccccagccgttgagacgaggtggtttcttgatttacagtttgaccgtcataattcagaaaggacatacttgtacagacaggggaggaaaaaaaaaagagcgtgaccatattgtgcatgcagacgacactacagcagaaattcatggtcatactgttgcacctctctcttcatcaaagacaacaaggctctcgacctcaatttctcagactaatcgctacccttcctggaccgactctggtttcctatttgctctctcatcacagaggttcagccaatacctctactggtttttctttaatccagcggagaagcgggccttggtaatgcgagctagggaaggcaaggtgggggtatcgtgaaagctaaggatcctatggcaaggcacgaaagtcaactccttttttttttttttttttttttggcgtggaagttcctttttggcacccaacatagcctaggcaagtgacgatctcatatcaagggaccaatcgcaggtcagataaaaatatctcaggaaccggagcgactgacaaccaatcaaaaatgcctgggatcccacagatcttccatcacatgaccctttttggcttgacgatgtggtcgcacggagggtccgtctttagtctcaatcccatcagtccagacacaaaaagggttctcacgagggagccagtggtctctctgcagtcgactgtcaatggggacctatgagaagaagagggccctcctcttgtgcatgcatcttggcgcgcggcgcttgatggggatgaaacggtagaacggaacgcgaggcacctcgacaatttgtgttacagtgattgcaccaatccagcaaaggtgaccatggactaattttttttcttgctctgcttagccaaccatgaggaccctgtactgccacattgctgcagttttagttcttttccacccgctttgttcttaccgatagatggctccacttctagatagaaagaaatctgcatgaatgtcatgaggtttgacctgtagatatgaagagcagtgtacagaacagaacagcctgcaatgacatgacctcatccgtcctggtacacagtaccatgggtaaattgttacattacagtcacgcatgatcagtgtggatcatcgatggccgttcagagatacattccgccccatcactatcctgtgtcgtgccctcattgctttcaagggagctacatacgtcaaggcaagggcgtaccggtaccattttcgcccattcggccttccagagagctttgggcggctcacctacaaatcttatgggccacgttgttgattcgacatcatggaagctcagtttcgacgtcgaaatatatctgctgtttcagtgctcaccaatttttttttctcggcctctctgacattgcatttgcatgcatgcagcatgtggcgcatgacttgtttgcgagccctctctacttcctagcctctggctctctctctgtctcttggtgggcgatggtgtctctgttacagccacaacatggatgctcaacagttggtgctctaacgagtcgacagcccagcttgctcataaccaccgctctgccttgtactgagggtcacttaacacgaagctctcgaatccctcagcaggcgatctacctttgccagtgatctacttcagcaggcgatctacctttgcaagtgatgtgcttcagcaggcgatctacctctgcaagtagtccacctcagctggccgccgcaagggagacgagtggagcatacaccggatacctgtttcagatgctgtcccatactcctctcagagtcagagtctttgctctggttgaaagatcagacaactctgctcatccacactgccatttacatacgcaccacgcgacggctaagggtgattgttcatttgggaggatcgtttgtgatgtctctctgttataaagccgcttcctcatcatcaacgtctccctctatcgtctccctcatcctcatcaccagccccatcctcatcagcagcaacagcaacaacagcagcaacagcaaggagaatagaaggctcgatggcgatcagacaagaaggaaaaaaaaaagatgaaaaggagaacttcagggtgaaaatcctgctgcttgttggctgctccttttatggatttgcttgcacttgctttcacgctccacccccttccaacccagtcgcatcagatgtgttcatcgtcctccttggccctgatgttacacacatcttgcacatgcctagcctaaacacacggttaggtcctggttatctatctttcgggtggctcaaggcactgctgctgtttgcccctcgctcgccgatttccgaaatgctacgaaatctgtttatgcgttatgcttgacccttgggcagatttgtgtccacatcagttgcagtctatgcggcccacccatccctcctctcctctctgcctccctgcactgcaccatgggactatggatcgaaccttcctcctatgcacacgacctcgctattcatgtgtttgcgctcgtctagcctgcctacatctgctttttgcacccatcgtatgagcttacgtctcaccggccttatgcctccttggtctgccagaaggccaagggaggaggattagagagaatccttatctttggtgtttttgtctttcctctcttctctctctctctctctctctctctcccacaccactttcgcttttctccacaactcactccacacccggatacatacaacaccgcttcctttatcctgtgataaccttgttcagccgaatcctagtctagttcagcccccggaaccaccaccttgtctctttgcatcatcgctatcttgctcattttttttctgtcgcgtcctttccgcaactcaaggcttccatccacccgccccccctcattcctctccgttatctcgcacaatcttatctaaggcccggttcctccacaagaagcccaaacaacaagaacgttctacaagccccgaagccatctcaagtgactatgtcgtccatcctaaacgtcctccggtcggctcccactccaacccgtcactttacgtcgctccaggtggtgtcgtcggccaagacgcagtcttcggcgttcaatccagagcaccacccgattgtgcttcagcagttggtcgagtctctgtcgccaaagtcgttcgtggcttctgcaaagacctcgacgacgggtatctctgctgctgtcatcaaggattctctctcgggcaaggcgaagaccacggctggccagtctgtggcgagtcaacagctggctcaaggacaagctaattcccatgcctgagtgggaagaggaactgaaagccacgatattctgaagacgaaaaagccggccgccttttactgctgtttttctctatctatctggtgacctgtcttttcctttggcgccattcaaattgtatatccccttctgcaaaaaaaaaaaaaaagatcctgacctagccaggtcttggacttttttgcagttccaatctgtaacatagacccctccttcgtaacgaaaatcgaacaaaaagataaaaaaaaagtgtaaatatgccctcagtgctcaatccgctcccccccactccctccttttctttcttttgtctgttccatagactcctacttgttgtcctcccctaggctaagatggtggtgattgagcggtgtgtagacaggaaaatgcgaataaagaaggagctataatgtgtgtctggttatgaccagtattgtcctcagccagccaagtttttcatttttcgtggtttggcccaaggttcagggtgcgaacgggtcaggcaggcaggaggggagatgcataggcgaaaagaatcacaaatccccggtgtacgcagtttcgaacgggaacactggaagatagaagaagtcagccaccgaaagaaggttcgagcggacgagacgctgttttgttcctgaagtccaaagacgcaaaggtgagaagcaacgacgactgcagtagactggatgtagactcctgtgcatgtcctcatacatgcacagcgcgtccgaccaggcaggaaggccctcttcgttttgaaagtgcgcttgcaggacgggccaaaagagagtttgcagcgggccaagaggccgacgactgaggttgaacgcggtgtgctcgtctcggctatcgggccatcccctgagccatgccctgccatgggcgttcctgagaacaaaaaaaaaaacatccttgtcgtacagtacagaagtgcatgggtagacctgttcagtccatgtccagtctatgtccagtccacctccccctctttctgctgctgcctgatgcaagcccagggccaccgctgtttttcctgactcccttaccgcttgacgcgacgacttttttctaattagcctcgctcgttctcgtcagcctgatcaccattctttcctcctcttcttcgctttctgtctctgtctctctcttctcctccacacatccttccttcgctcgcgaggccggtcctcctcctcctcttcttcttctttcacccctttttcgttattcccgcaccccacgccatcctcacacgctccattccaatgaccacccgctcggccagacacatgcaccgacccctgtcctccatttgacccccccttcgtgactacagaacaaacaacgcgcgctctccctcacaggcaaacatacccgcaaggtaaaccatcccatgcatccacatccaccagatatgtatctatcgatgtacttggccacagctatcgagtcggtcgactgcaatcgactgcagtccgttgccgagacccatccgacttattcctggaccgagctgcattgggacgcattcctccctttatttttcttgcgtgtgtcattgtcgcagcaaggagctctcatggtcctcattctcctcattctcctcattctcctcattctcctcattctcctcattctcctcattctccttctcttcttcttcttctctctctctgtcttccctcttgctgacacactctctgactctctcgctactcccttccttatttcttgccctctctccctttgtcactccactttccatctctcagcttgatccctctcttgcatccacaagccagtcacttttatagacacaaccgtctcagagcaaacgaatgcgtcctgcctccccagtcaccttgcacagacctctggccgagcacgagcctttgtcctcctccgcgcagacgcagggtccgttagacgtagaccacactcacagcagaaagaccccgcacaagagcataccgtcgtcctctaaagatacagcagccccatggacacacaaggatcgtgatcgggagctaagcagccatagctcaaggtaatcatcatagacgtccacgtccacgtcttttgtcggctggccacagggtgtaatacaactctaatttgccgagtgttccaccttcccactaatccgcgcttcgcccttcctactgcctgttagcttccttgaaaacggcacaaagatgcagtctatcgagctaaagcagatacccaaggaccaagtcagacagagctctttcaaggacagtccactgcagcaacctcagcacagggggaatatccaaaagacagtagaggatcttcatgtgtcctcactgaactcaaaaccggcgtcaggatcacgtcagggctcctctcgaaccgttagacgaccatcgacaacacctcaggaggcagcacggctggaacgcgttcgagccacggtgcgtgcgttcttgaacaagcgcttctcagcgcacgagtacacggtgccacggctctttgtcgtcctacccgagactgctgacgtggatcgaccccccaaggattcgtccaacaagtacgagcagtcgggtgcaagagcagcaacagagttcgacaacaaggatcagggaacagacgccaaagactcgcctcctgtcgaccactatcgcctctacttcttgtgcgaatgcagcccgagcttcacacacccgctcggcagtggactcaatcacctgcacattgccaaacatccaggatacgagattgattccgggagactagacgaattctttgaccaatacggctccatggtgctgatgctactcctttttctcaaacatggactggatccggccactagctctgttgcgccattacaaacggctccagatgcctctcagcaacattctcagcctcccgagccaagcgatgcgtgtctgaagaaggtggaaaagatctcgaacctaaagaggtcagacttaccggactcgattggtgcgcaggccgaactcaaagtcaatcggatgattgattacctggagcgacatcaaaggaagcaccgggacacggcatgtagtgttcatggtctggcaaaagtagaagaggacaattccgcgaaggctgagaatggaattgtcaaagacagcaaggacgaggaggtcctacaggggctggtcagtctggcagatcttcatcagctctactcattcttgggaatcgccaatgtcagcaggagattacaggcggggcagctgggcaacctctaccgcatcagtaacgtgcggggtcaagtgagctgggtctgcgtctatcactatcgatggacatttctcgaaaagaacattgacgagtttgagcattggatcgtcacccggcggggtctctttgacaaacaatcaggatccgtcatgatgacgcttgtctcccgggcacatacccgcacgttttgttcatggatcagcaacaaggtcgcgccatcgctcgtggaggtccatctaaagcttggctggaagtttggcaagaaggatctgtggagaatcgccaaagcgctcgcccactcgactgtcacagtactctctctggatggctgttcattcgccgaggactctagctatatggcgctgcacaaaaaatatgacccgatcctgcacctgctcacgcacggccagctgcagtctctggaactgctacgcctcccggctctgtttgcgaggctgtcgcaaaaacacgtcaaggctacttcactcaaacgactagagttggggcaagggatggaggtggacccgaaagatcgagggtctctcagtcacctgcttgcatcgtgctcgtcactcaaagagctggttctgccaggatttccagccactgatattaatatccaggccatcctgagcggcattcgacccaggggttccctcggcactctggacctttccaacagtcaactgaatgatggcggagccattcttttagcgcaggggctcttcaacaccaacatctgtaaccttgatctgtcgaggaacgagcggttatcggacgtgggcgccgcaagagtgattcgggcagtgggacctcgattgacgagtttaaagatggcccatacagggttcggagattcagcagcggtcgcactgagcaggagcatggagggcatctcgttcaccaacaccctgagggaccaacttcagctccagcaccgattggacattgcggcattgacagcaggacatcgaccaggcgtgcgccttatgatagaccccgctttggtgcccatcccagcaaggtctcagcaggaaccccgagaaaaggagacccgagtgacctgtcacctggtctatctggacattgaggggaatcagtgcagcgtgcaagggttccaggcgttggcaaagatcaaggcgcgactccatctcgtctatttgaatctcgcaagcagtaggggcctcgaggacgacgaatgtgcacttatcctgagtcgactcgtgagctccgagatgggcgtactgcggcttgcgtgcactggatttggagatcgatccgctcagtccttggccaaagctctactcgaacaccctaccaaacccagcggctctcgcttcaggacctccaggtcatatcagctcgaggagttggacttgcgagcctgtccgatcggccctcaaggattcacggtcttgtacgaggctctcggtcggatcggtgcagcatcttgcttgcgggtggtggattttggtcactgtggatcgttgcaggacgagatggcgcagcagttcctgaagatgctcgtcattcccaacagtatcgacagggtgaccccaaagccagcagtatcaattcgaaaatggaacagccagtcggttgcaggctccaaatcgatgacagccattgcagcgcttgcgtcgcagaggaacccgaacacacatgggctgacaccggaggacgcgaatcgttcagacggattgttaggtgttaggcgcgggagcaggagtctgttgagcaggtcggattctgtgccagccatggccaccttgcgctccgaaccatacgacgtggacgacggagattcggccatcagcgctcaggagttggcccgacctccaatggcacaactcccctctgtggttggctttttcaccaacctacgagagctggatctcaaaagcactctcattggtgacgaaacagcgtggacgctagctcaggcactcgttcagccatggatcatgcttggaaccctcacactcctggatcccatggcgatgtctgtccagggcctgtgctggattgttgatgcactctgcgagaacttgactgttcaagagcttgggatcggcaagagcaacatcatgtttcagtctgagctcgacctctttggagcggctttggtcaacttgatggaggtcaacaagcgcatccgatccttgaccacactgggaactccattaggttcaattgccaaggggctgctgttgaaccaacacctccattcagtgtaccttatccgatcgcgaggtcattttgaggatctgcagctcctgggccaggccctcgccttcaaccggtcgctgctcgtcttttggatgggtggttcggatgaaacgctcttgggcgttcccacgccgaccctggaggattatgaggtcgagggagcaggcattcacgggcactcgtcccagcagcaggatgaacagcagcagcagaatcagagccagaacatgtatcgcaactttcatttattacaccagcaacatgcacaacttgagcagccttcgcagcatcaacagcgtcaccagcccaaaggctatcaaaaacagaagctgcagcaacaaccacagcaacagcaacagcaatcgcatcgtacgcggctataccatcatcacagtgcttccttgtcccagcggatcggctcagcgatcaagaccacgttttcgttgcattccaaagagagtttgggtctcgggggtcgacaccgcacacacactcagaatgagagcaggaccacacgaggcggcgcgacgtctgggtctcggatctcgccgagctcgacacctatgcccacggaccctacgcatgcgatcaacaaggcgggtctatcgggtacagcggccaatttctcattgacgggacaatggacccggaaccctgttttggaggggattcgacggaaccatagcttgatcaaggtgacgttggatgttgtgagtcccatggcggggctctcgagtccgctgaggatgggcacggacgatgagatggatcgagtcagcggaaatggcggaggaggaggagcaggagggggagggacgagaggagcaggacctggactgagcagtagtagcaacaacagggctcatacaggcgggagccaccttgcggcggcggatgggtatcagctgcaacagctgcagttgatgcagcagcagcagttgaacaagaagattcaggcgaaccgcaagttgctgcgagatcgagggcgtgttggatgggaggagctgaagctgctgggcgtggatgatgatgtgatccgggaggtgtgttcggaggtatgagtgtgtataatacatcgatatagaacaaaatgaacactaatttaaacaggatcaaagcgcgttcatgatttcaaccccttgcattgttgttcaaacctatatattcattttgcgttcgcaaagagtagtgacccaaacgaagacagggcaaggtctaaatctacggtagatttttttttttttttttttttttatcatcagggtttgtttggccagcgcgaatccaacacggtgctagcccagatcgtagacgctgtaatacttgcgcaagaacacatctccgatgacccagagatcgacgaacgggtctgcaaagtccatggccgtgaaggcccgagtaacagatctcttcgactttgagcacatagtctgacctctggagcgtgtacttgtcgttgcccaagacgagggtcaggtctggcagatgcgggaccgtcgagcactcgagcgtgtacagactcttgtggaaccaatgcctctgggcgccgatctggtggttgagtctgtggggcggtggcactgggcatgccgatgagcgaggcgccggtgtcgatgagggcgcctgcgccgttcggggtccagctcggtctcgcccaggtgggctttggtgagctcgatctcccagaaggcttgacggcggacaggatgccattggaggtcaccggtgaagcgggcggggtccataccaccgagcatgacctctccaccgattgcggaagtgggatcggtgggatcgatgcgtgcgagttaccgcagtacttttgcttgggagagagaagtggccaaaagaagaaggatggcgagcagaggggtggttttcatcgttcgtgagaaggtgtagacgcggtgagaaggtattgtcgcgagagtctgtgcgagagtaaagtttgtttgcccgagcgcgtggatatcatgtgaccaaaacagcagtccgatgtaaacagaatgttttttttttcttttttttttttatccccagctgcccttcgtcgtttttgttctccgtttcgcccttcacgcctccatccatccatccacttcccacaccaccatggaggctcactttgcgaaaatcaggtgcggacacacgattcagccttgcagtcgcatgcgaatgcactctttagcgaactgcctcgttgtcgtagagcgtttgcagcagcaacaaccagggagacaataggaaacgaaagacttatcccctttcttttttttctttccatcttttcttctcggtgggtagaacgcagatggcgtccaagctggcgaaccagcagatgcatgcgaccacgctgctcgctgtcgaagaggtacttgctgccaggaaagtgtttccggaaaatagagttttttttgacgaggttctgactagggtgtcttcttttttgcatgcatgatctggagtagaccctgaaggagcaaggagccgagatcacacccaccgcgtactttgccacattaatgtcgttgctggaccagcaaaaggacgaccctgaggtcgaggagatgagagccgctatcctcaacctacttgccatcgtcttccctaggtaaggagcgagttcatctgctacctattctatacttatcacaccttgtactcatcctctcgtgtgttccttcttcttcttcacctacagcgtccctgtcagcgtccttcgatcccaatacacccccaccttgagcgtcatcacaaccatcctggcgcttcagcctccacccactgcaccatccatgcgctcgttggtcacctgtctggaacaccttttgatcgctcaggactctgcagcatggaacaacaccaccaccctcaaggcccttcagacgcttctcattctctcgctcgactctagacccaagccaaggaaaagagctcaggaggctgtcaggaatattgtcacacgcccacctctgatgatgattgtccaccccggcatgaaggtcgtcgtccagacgacgctgcagatcctcaaggagtctggcaacggtgttgtgggtgccgctggatccaaggacaaggagaacgccactcagatgatcctccataccctccagcttgtccgcatggtcggaaaggcctggcccgtagaggtactgtgaagatgactattgtccttcatttttgatcagagatggttgtttgcaaaacctaccagagaacttacctttggattatcatttcctttacaatttagcaattcctgcccctctgcgacattctcctccacctccccaaacttaacaacccatacctcacatcctccgccttccaagtattcgagtccttgttgtcgccaaaggaatcggccgaagctcccactgtcgttcgccagggtgactcgcccgagcaggctcccgtggagactatggatcacatcgtgtcgagactcgccaaaatcacacaggtcatgagcgccgtcctggagctcaagccaaacgccaatgacgctacgctgatgcccctgtggttggatgttgttcgcgctggctttgtcgagtcttcgagacttcaggatttgatgcgagcaggtggccatgtcgcccagatccctcaggaggctgttgtgcccctcgcccagctcttcaaggtcattttccccaacctcgactcttccaaccccgtctctgttcacaactcgactgtcgactgcttgaaccaccttattcgtcactgcatcacggacgacatgattgacattgctgtgcaggagatgaagcgaaaccgcggacagcagcctgagggcaagaagaagcgaaacgtcattgacaccatttctatcaccatcaagggtggattcgacattcgctaccagagctcgtggttgggtgttttggacattctcaagaccttgtttgagcgtctgaaccacgccgccaaccccttgttggtttcgttcctccccattatcgacgagctccgcttcacgcccgccttcacgcaaaaggcacacttggatgttgtgttgtcgacggccatcagcacggtcggaccccgcatctttttggacaccctgccactgaacattgacaaccctgaggagcgcaagcgtggccgtgcctggctcttgcccttgctcaagagctctgtgaccaacacggagctggagtactttgccaccaccttgatccccctggccgatcgcctgaacgagaaggctcaggagtgcagggagaacggaatgatgaagaaggtctacgagactttgattggccaggtctggagccttgtcaatggattctgcgacctgcccgtcgacatggagatggcgttcacaaaggaggttgcagagcgattcagcaatgttctttactctgttcccgatcttcgacctgttctctgccaggccttgaccagcttggtggtccgcaaccaggccattgttgccagctcggacagcgatgagatcttggagcgcaagtacctgatcaccaaggaggaggcagcacgcaacattgagctcttgcagcagtactcgcggccttacctcatggtctttttcaacattttccaggcgactctgccccagttccgtggatacttgctggaggtgatgcgcatgtaccttagcatctcgacccccacggatttgcaggagaccttctcggcccttcttgtccagttgaacggagccctgacgacggttcagccccagcaggcggatgcaccccccgcgtcccacaacttgatggaccttgccgacatcatggtcccctacgtggacgcacagagcatggccaacctgtactctgtcgttgcttcgctgtttgcgaacgatgcggacggtgcgttgcagaagaaggcctacaagattgtcaactcgatggcggagactgagactggccgtgtggtgttgaagtcgaacctggaggagctgatgcgcaacattctcgacacaacagccgcagcgaccgctacggccaagcgtgcccgtctgtcgttgattggccaggtgatctcgctgttggagcccacggacttgtactttgtgccttcgatcctgtccgaggtggtggttgcgaccaaggaggtcaatgagaagacgcgcgatgttgcttatgcgcttcttgttgcgatgggacacaagatgaaggctggaggagtgatctcggccgagcgcgttggtgatatggagggaggtgcgacggagactgcggcttcgatcagcgaatactttacgatggtgacggctggtttggccggtacgacaccgcacatggtctctgcagcgatcacgtcgctctcacgactcttgtttgagttccacaaggacttggagccatcgatggtgtccgagatggtgggaacgatgcacttgtttgtcaactcttccaaccgcgagattgtcaagtctgcgcttggattcatcaaggtcacgacggtcagtctggatgtggaggtggtccggggacacttgccccagattgtgagcggcatgatccgttggtcgcatgagcacaagggccatttcaaggtcaaggtccgccatatcctggagcgtctggtgcgccgattcggatacgatgatgtggtggcgtatgtgcccgaggccgataagaagctgctggtcaacatcaagaagcgtcgtgagcgtgccaagcgcaacaagaagaacggaggctcagccggcatggacatggatgaggaagaggccgaggagggagaggaggactcgagcaagaagtcgaacaagcccctgtacatgcagacgacgttcggtagtgcgtatgaggatgcgctatatggcagtgagagtgatctcagcgacgatgacgaggaggaggaaggtggcaatgagggcaaggctggacagaaaaagtccaacaagaagaagcaaggagcggatgcgtggatcaaggaggatggcgatacgcctgtggactttttggaccggacggtggtgtcgcgtgtgaccgcatcgcaccccagcacacagactgcgcgcaagctgaaggacctgtcgtcgtcgttcaagacgtcttcggatggcaagctgatgattgaggagagcgactctgagaacgagggtggtgagggcggtgaggatgctgaggtgggtgaggagcagatggagctggaccaggccgagaacaactacctggagtcgcttcagtccctggacggtttcacgcgtggacagggcggcaagatcaagttcaacaagaccaacaagcgcggagtggtgggtaaggacggcgacacggagatggagcaggccggtggagcgggcccgatccgcaacaacaaggcagcgggcggcaaggagcagcggtcggtcaagggtcttggacaggatttcaaggccaagaaggcgggcggagatgtgaagaagaagggccgtgtggatccgtatgcgtacgtgcccttgacgtcgctgcgcaagggagccaaggagggcctgagcctgacgaacaagagcaaggccgagaagcgcaagcagggcaagcctggccgccgctcatagactaggcgatattgctaaggacgacgacgtttatcttttttccccctgtgttctcatccgtatctctcttttttcttttacaagcattctcacacccccatatcattcattagttatctattaaaatcagttgcaagtcgaaaagaagtgtgaaagtgactgttgttgactgttgcatttttttttctttttttttatgcccttcagctacctcctgcccttctttttttttgttcttttgtcactacagcaccattgcacccgacacgatggcatcctttgtccttgttctttgagaaagaacaactgtccgtgaccttcttcttcttctccttccaccttccaccttccaccttccaccttcctcttcgtcctctctctccaccttccactaatcgcgcattcccctgtttggtgtgggtctcttcgttcttgtgctctcgtctgctgattccccttcttgacttccaacagacctcgtcccaggtaggtggtccaccagcaacacctccctgtgtcctcgcccgcttgctcgtctctcactctctgtgctcgctgtcctcacaacgtgctcctctcttggcgttcgcattcatagaacttcctccgtcctgcccaccattcccaccctcacagctccttcggctaaaggatgttggattcagaatctgcatcctccgacctctccgacgcctcgtccttgtcctccgataactcgagcgggtccgaggcagacatccaaaaggcgccgcaccggcctcccaactcgtcttctttttcctcttctttttcttctccacaaccacccactcacatcaagctcggcctgtccaaatcccctacttcatcgccctcagactcggcctcgcagtcgtctgcggacgaggactcttctgatcaggatgacgacggcaacgggggacagggcaagcgccctccccagcacatcctcgccagccaacaatacccgaccaccacacccaaagcgcgcaagccaaagactccttcggtcaaacagagcagcaacgcgcccatctcactctcggcctcacagcccgtgtactctcatcaagagatcaccgagggggccttggctcactcgcactcagcggcttctaggccacatcagcaaccgcacccacccactgcagcccgcggcagaggtcgtggccgaggcaggggttcactggctggccatggatcccgcaagtacggaggctctggccccacagtgatcgactttacctcctcgtcgccacctcccgagggacagggccctagtctcacgcagcggatgaaggccacgacacccactccctcaccatctcacatcaacgcactcgcaacacaacaactgcagcctgtcagcctggatcgggaaaagaaggagccttcagcagatcgtccaaaaccagcatccaaaaaagcagcgggaggaaccagcgtcaaagagaaaaagaccggcgccaggaaggtaggccggccaaaatcagtttccaaggatgtctactgcatctgtcgtggaccttacgacggtgtcgagtttatgatcgcgtgcgatcgctgtgaaggtaggcagacgacgaccgcaaggctgaaatgtagttgctggcacgaaggaaaaaaaggggtgaaagcgacgcacagacccgcaaagattatccaagatctgacttgtgtttgcttcttcgcttttgttctggcgatagagtggttccatggccgctgtattggcatgaagccgcaggaggccaagaaaagcaaccactactattgcgagacctgccagcggctcaggaagatgttgggagtggccacagaggagccgcccaagcccgtaaagacgaaggatccaagcaggaaaagcggcgacaaacgtggacggaagaagaggcctgcagtggatccagccatcaatgaccacctcttgccatccgcctcatccgctctggggtctgcacacgcactccacacgaatcccgtccactatgcgcttgaccagtcctcagctgggggcgcagtcatatcaaaccaacacccgacactcatggcggctgagcagagacagatcccacccatcagtctgcagatgcaagttgctgtggagacgagcagcgtgtcagcactgagcggtgtggatgtccagcaaggcagggaaggtataccgcctgcgcgctatgacgcatcccccaacatcccttcgacacccatcagcggtggagtaaccgcctctgctcctcaaggtaaattattattagcccctaccagcagccatcaagtcactaccatcttcagcttgcaaattactgactccgcctgggactctgatcttcgaatttcctatctccagctcgccccaccccttctgtccgaagcgctcccatcatggccgacgatgacgaggacgaagaagtgtgtccagtgtgcgattttcaatgtacctgtaacaccaacgcgggcagcggcacagaaacggcagttctgactgtcactgctgcggcaccgagtggcaacgacgagcacacctacagtgcaatcaaagtgccattccaacccaacttcgttccaggaactggctctgcagatccaggaattgaagggcgcgatccctttattgcggactctgctaccagtgcggtcgttgacaccaccagtatcaaaggcaatacctcagaggatgactcgttccggacctctcacaagaatccgatgtcgaccccaacgagccaaaggcgaccatccattcttaggaggagcggcaagggaataggaaaggcaccgtacttgttgcagaccagcaaacgaaacgaggtcttgcagcgtcgtggcaagagcttgaagggtgggaaagcagcattacatttgtaccagcagtcgatccagagctcaggatcagagatgtccgacatttacagcgaggacggtggcgattcagagatgaggggtcgaggacgggaatattatgcgcgcatggccccggatggctcgggctcgacgcaggggccccgcgctagatatgcaagcgacagtgacgatgagcgcgaggaagaaggagacgacgttctgtcattgagctcttccagcaccctcagcgattttgaagaggacgagtccacagatcgaggagaggcccaagcggatcggatacgctggaagggtcagagagccgcctcacattcggattcgagcagtaggccggctgcaggaaaaagatggacccagccccatgtcgtcctcactgctgcatctattcgacagcatcatgaatcatccctccctcccgacgcgcgtatcagggtagctgcggagggtcccgtcgtgatcaagaaacgaggacctgggcgacccaggaagcacaaggatcttctgcttatcagtccacaggatgaggaggcactctacactcccgctgtcatcgcctccagaaaggcagcagtggcggcacaacccctgaagcgtggaacaaagaaggacgtccaggcacctgtcaagagcaagtctagacccgagtttccgttcattgcctacgatcctgacgtggcagaggatgtagcagcgcttcatgccatcgagagcgacaacgaagataatggcgtcgcctctggaccgacgtctacaaacgccaaccacttgctcgacttgagcgacagcgatgacatctttggcgatggcgacttgagcgacgagctgagtggtgatctgagcgagataccaagcgaggatctggacgacctctcggacgatggactagactttagcagcagcgacgaggaggatgatacgagcaccagcagtggcccacgagagtttcactactccgaattggaggagcaggatgaatcgttggtggactcggactcatcgatcaactctattaccagcaacagctccgaatcgaccgattcggcaagcgattcagaggtggaagtcttcctgcgtgatgtaacagatccagacgaggagcaatacgagtacgagcatgaaggctctgaggacctgatcgatgacgaggaacttttgcgcctggaggagcaggagcgcctgttcctggccaaggcacacggtctgcatgatgtgtttagtgaggaggactcggaccccgggcgcaatccgtttgaaagctcagatgacgaggatgaaggatacgacctggcgcccgacgaagacgattacggtcattcggatgagttctacgatgatgagtattatgaggacgactacgaggagatggacgacatggagattctcgagcaactgactggcgttcagtcggacatgcaggcattgatgatgattccgcccgagcagcaggagcaactgctgctgctccaacactatgccgagattcaccgacagcagcaggagcagcagctttcaggcgtccagctgcagcccggcgagatgctgcacctccaggactcttcagcagaggcctttcagcgccacgctgagcatggctcgccagtgtctgatctactgtcctcacatctgctgcctcagtttgatatgcatgtgccagatcttgatgcagtgtcggagcagcttgctgcgtctctcgccagtagtcttgccagtagcatggccgagagcatgtctggacagaatcaggacacgtccatgttcacgacacagtccacaaccgaagatggcctttcaatcaacctccagattcactctcttacagagcaagtcgttgctctgaagaaccctggcgacccaggtgagacccacagcggcggctcttcaggctcgactccctccacaacagccgaagcttccgtgttcacatgggctacctctgtgcccacgactcccaacacgctggctatcatccctacgcctgccaacaccccgagtccgtctgagagggttatgggagaatcgcctcctagtgcctctaccaatgcgtcgacacagccacctcagcacacgccatctatttcgagcaaggcccccaagttggctaccttccagaagggccagagctcgaccggaaaagtacagacgcttcacaatagtgcatcttacaagccgttatcgtccattgttgctgtgccgaccattggtggacggcctgtgcagcccatcttaccaaagctcgcgcccggcgaaagtttgtctgggctgagtccgtttgccaaagctcatgcggcggagacccagctggcgcttttgaaccagacgcgtcttcagcatggggggcccagtgttttcaaggaggcggcccagcgcgctttgggaggcgttgccaataacactaccacagtcccagaggatacagccagtggtgacacgactgatgatgcttcaccaaacatgcacagtaccgagttcaagaagagaaagggcgacgatgccaaggtcaaggaggtaaggctatagcatgacttgtaactttcgtgctagttcttgctgccatagtcactaactgcatcctctgtacaacgttttgtcatgcgtagcagattgtagttggtcaaggcaagcgtcggcgtttatccactgtgggcaccaaaaatcttgcaaagcacagcgccgcacctctctcacaaggaacgccaatggaccccactcagatcggtgctctggcgacgtctaccatctcacccggatcgacctcggcctctgtggcttccctgtcttcgttcagcacgggagagagtagtagttcaacgtctctggctggatttgatttttcctcggtcgacatgccatttgtcgaccccgctgcacggatcatcacccctgccatatcgaagcaccaacggcatcgcaagtcaagcctcaagggcaaggagctgaagcagtcggattctggagtgctccccatggacgatctactggacacgtcggcactatatggccgttcctcttcaaggtcgccctctccggagcgggcgggagctgacggtggcgacggagatagcgagatgtcgcagtcgatgctcaaggacttgaatcgatgggaacgtgtaccgattggcacattcaggaagagccgtcgaccgagctcatcctatgttgggctgcagagcgcgctcaaattcggtaatgtgagcatgcctgcgacgttgttggcagatcatcaacagcagcagcagttactgcttcaggaatctcagcggccaccaaggaggaccttgggtgttcgaagacatcgcacatcgtccaacgcctctgatttcatgtcgggacttcaacgcaaggaagctattatgcaggaccggctcttgaagagcagacagcatcagtttcgtcagcgggcgacgtctgtctcgcaatcatcgtccggtgtacaagctgagatgctactggaggggtttggccgccaggacggacgccattcaaacggatcggggtcgcttcatcgcacacagtctagctttggggccctggatagacctttgatgtcgggaacgaacccaatgcgtcgaagaaaacgagctgggagcagcgcaactgatgtcctcggagccggtcaccgcaccaatggccaccggcggtccataggccaacagctgtccacagtgccgtcggatctgaacatggatcttcacgcaggacttgggatcggcttgggcgagctcgccagtaacgggatcgcttctgcaaagaatgggcacgactctgaaggcaccggtcgggcggcaggactcgaggatcttatgacagattcgaatcagctgccgtcctcggcttgccccacgccgttgcattcgccccttttcagtgccacgagcgccagtggacgagttcaccatcatggctcgggcgaggcggtcattacagagagtcagagcagtaagggctccctaggcgatgacgatggtcctcggggagacgatgccattgtgtctcatctggagctggatattggcaaagagatggacgggttccatgaacgactgatggccaagatcaaagcggactcggaggagccgtaagcgcatttttagtacttttatctcacctcacctcacctcacctcctcgccttttttttcattgattttttgtaccttcggcatatctttcttctttactttcatttcatttcattacccatcgtattttgttgtcatatttctaccctacaccaccaccacacttgtacaaaagagcaagcaccgcccggaggttggctttagtctccggagcgccttgtttccttccagtatagctcattcatcattgtatcaacatccaaataaagaaacgcgttagatcgacaggccgttgcgaagcaccttgcagagacgacaggtggatgagtggcgtaccactgagtcatcgtggatcattgccgctcgatatatagctccaatgtcctttacggcgccctgctgggttttgtttgagactgtccactttttatccaggcacagcacgagatatctgaatctcaaaaaaaaagtataaaaggtcacctttttttcactttgaatgaccgttgactcgtttgtacatccacaccccacaaacaactaatccttcagaatgagtgccgcaagtgttgtccaagtcggactgggcgtgctgatcatgcgcaaccaccgggtcctggtcggaaagagaatcggaagccatggcgcaggtgagaaaaaacgagccaaagacgcaatgtgctgttcctgtgagttgttgttgtgctagaggcgaatggcaacggacgttgacaatggactctgatgtgttgtaatactattagacacctggcagctcgcaggaggtaaaagagacaatccacaaaacactcgtgcagtcttggacggtctctttttttttttttttttttttgctttccttcaagtcctccagagctgaccagctgttgaggattcttttgtgacaaaaaaacgttaggtcacctcgagtttggtgaaacgttcgaagagtgcgccatccgtaagttccccctcactctcactcacccctggtgtacttgttgttgcgccgttcttagcccagtttgatccaccccccaccccccatctccctgtcccttcctaaaagatctatttttttttcctcttttcatttcgttctcttactcacaggtgagtcgctggaagagacgggtctggttctggacccatcgacgaccaaggtcgtcacggccaacaacaacatcatgtcgtcgatccagaagcattacgttacagtctttgtctcagccaaggtcacgggcagcagcgaggccagggtgatggagcctttgaagtgtgaacagtgggagtggatcacacaggcacagttgctcgatcatcaagggccctacaggccattgttctcgcccctggcaaagttggtggaggagcatgacttgaccagcttgtttgctgagagtggatagagagggtgttgttcgtatttgttttttttttgttttgttcaatgtacagttgtagttgattgccctgccataaacggggaatattagaagtcgtttggaacgagagaggttttccttgaaaagcatcaggtcttgggcgctgtggtcgtaatggtctgtccgtggggagagggcagaaaaaaagacggggcattttcatggttagattcgagagtctttgaaaggagatctggtacaactgtctgcatggaccctttacctcgctgcagtacggacaggcaccaaagagggtatggaagctttgacgcgtggttgggacagatcggagccactagatccatccgacatgcaagaatatatatcagtgtgagttttggcgagaggcttgagggaactaatagcgcaccgatattgctgttcaaaaagatgccttacctcgtagaggcagatgcgatggaagggctgctggcatttgacgtggctgcagagctgatcaggcacttggccttcataccggaaggagtagcagattccacactcaatattcatctcgtccttcgtcacatttgcaggcgatgggaagccgttcgtcagttccagcaggacttcaagattctcgcgtggcagttttcctcgatccctgtaacacgaaacattggaaaaaaaaggggggccaagtaagcagcagagcaaaaaatggggaaagaaaaagtcgactgccgaggtgatttttttaccataatactgcgttttgatggagttttgcccgcatcggttcaatgctggcggtgggtccatacaaccgtgtctcgggcattgagcgtggcgacagcggatcgaccactatctgcagcgagcagtggtttcctgcacgagatgaagagaaaggagtggcgtgagttgccgcatcaaccgctggcaagtgtggcgttcttacatgcagggtggtcaatgcgggttttacctagcgcacaccgacgcatgcgatcggctcttgttggtttttctgggtcaatgacccaggtcttgtcgtcaaagtcctgcatcacatcccagaactcgcggtatctctctaattgctatttcatgagcacacattttgactagttagtacttttctcacgtcaggtctttgttgaggtgaagagatctgtgattttaccttctctgcttcttggatcactgactctagtcgatatcctgacttggatgaagcgcttgctgttgtggacagataaccgaggcctgttaacccatgctcagaatcactcctgggtatgtccagtggctccaggatcagaggcacagttggataccctggtgggaatgtcacagtcaacaggtgctttcgttcagatgcatcgctagagttacgaaagaccgatttggtatgagtggagcgcaggagggactgagtatgatcgttctcgcctcctcttcaaggaccccgattccttaccagagttctatttgcacttttgagagatcttggctcatatgggtgaccctgtgccagccaagggtgtccagttgctctgtaatctgtgaaaagtaggtgacagactcgcttccgttgctggctgcgcgcttggcactcaagatggcttcctgtttgcggtgaataatgcgcagagatcagcgagaatgcgctaggtgcggcaacgatggtggccaaggtagttgtcaagtcttgatttaccagagtatccacgagctcgatcagaaaactctccatgtccatggtctcgtccattttctaaggcagtacgtgtacgatcggaagccctgtatgtatgagtgaacgcttcctcaaaataaccaggtagatcccataggtgtcccctgccactgacctgttgcagctgtgcttctcgtcctgccaaaatctcctgcagttcttctgttccaaagatgcaaccgtgtttgctggacaggatcgcctggggttcaatcatggaacctagatagggctccatcccgccaccctgggcactgttaccgggaagctctatgtacacttccagctctttgtcctgagaacagacagcgtcgctgtgagacgctcgttgtcgaccacgtcttgtcatacataagcaagcaaagcgggtcagggaatgcagatctcttaccatgacggagaggaacccatggtagccgtcgggattgaatctccattgaactaggagtgggaatgcctgcatttggcgccaacctgtggagcgatacgtgatggctatcaaagtggccactggggtgatcctgattcacaaggagacttcgggctttttttatttttttttttttttttttgagtggtcgctttcgaatgtcacgcacacgacgcgcctggtttttaaaaagacgtggaatttcgcgacatcggtcaaccttttgccttcatccatcacctcgcaaaacaactggtagcacattggcagaaaaatgcgacttgagatcgttggccatcaaggaaggacacgcaaaagtcggacccattgaagagacagtgaactgagcaacttcgcttcaaacgcgattcaggggggcatgaacaacagccggtctcaaagtcctgccagtcctttctgcgagtaggatcgttgagccttccctcgggtatgtgagatgctgagctacgtataccatgcatgcagctttgcattgaattttacctgtgaggaagttgtattcacaacttgattgcgatttgcggggcgtcaaaggtttaagcggggccaacgggcggcttttgatgcaaggcagagccattggggatccggcagaaggcactgcgttcaaaatcactagtaccgtcgcactcgcaacatcgaaattccaccatctgtggtatgagctctgaggagtaggctagacttggcaagcaaagatcacactgtttaatggcatatacaatgaaatgtgggtgcgacgatcatcggctctgaattatggaaaacatatatgcaagggaaggaagaaaagcgcgtgatggatcgaacggtggctcctgcggcgtacagttatgcaggcgagacaacttcgtactcgagcccgttcctggtctggtattctcgcaacgcctcctctgcaaagtccatcaaatcgcccagctgcagatgcgtgcccaggggccactgtatcttcggaaaagtcctgattcgattctcatacaccaccataccatccgcaccgactcccgacacaaccttctgcatctgctctacggtcgttgaaaacttggcggtggtcatatgatcttcactggcgcgtccaatgtcctctgggtggatgcaccacttcttgaacgtctccggaaactgctcccgtgcaaaatccggcgtcaatgatgctttacaatcgtccagtttccgctgcaagttggcccagtcctctgcgttctgcaagactctgaaccccaagtctgcagaaatagtgaccatggcaccgtcattcgaggatgacgatgaggactgtggatgggaagtccttttgaactgatccaatgcttgcatctctttacgcagtcgataattggagtatatgtggcacttgaagtaaacaagggcttccagcaggtagctgagaccactcagcgcttgaatgttgtctcggcattgggccgaaagcgatcttgaaaattgtttcatgctctcccaacacttcatggcctcctcctgagccaagtcaggtcgcgtcgggtgtaggtgcgccagatgtcggtcgttgagatggaaagcacggatgaaggcgttcgagctgagaaagtacacgatcgcgctcagacgagcattgttttgaacccgattgatctcgtccgctttgcgcttaagattgactgccagagtgtggtatcttttacgaagtaggaaaaaggcacgactgtcgcgttagatgatttggacaaagaggtagatcgagcattttgtcttaaagcaagccaaggtaagagttactcacttgcggtactcgcggaaatatttagtgtccttgttcgcggtcgcctcccttgccgatgttttgcggatcgtttcatcgagtggatgtcctgtttttccagcaggcaatgggctagatgctaccagagctggtgactccgcggtgagcttgggcgtatccatatctgtgcccaatcgcttccgttggtattcttccatgtgcaacttcttcccagacgctgggccggagttggcgttttcgaggctaccggctgatgatgcctttggaagcgagtcctgttgcggccgagactttgaagatgagcgtcgtggagacgaagatcctgcccttgttgctgactgtgagtcccgtcggctagcatggtcaaatgctgatgacgagctttgaatgctcgatgatttgcggcgatcagtgccctttctcgatgcctgcgactccagagctcgccccccatccttggtatctgctttagacctcgatgtggatgctgtagtcgattctctactgcgtttatcgctctgacgtctgtcatcggtcctctctctgtccctagatctggatctggacctggatcgtatcttcttcgagtttcgaatcccgtctctgctgagatcccgttccttgtccttgctgcgactcctatctcggcgcttgagagtgggtctatcggagcgttcccggctgacttcaggctgccgagccttctttgacaaaggcctctcatcgtcataaccatgccggctcccgcctgccttgctgtcgcggttgttctcttctcgttcatatcgtcctctggatgatcgggaacgcgatctattcctggagcgatcacgtgctctgtgtttgccggacttgtctctttcctcccgctcccgctgcccagcatgtccagagcgacgactgtcatcgtctcgtgagtgccttctgctcttgctatggccgtcgcgggatttactttttgatttcttgacagattcgttctcgggtttccgaaatgatcggtccgtgtccgaatcactcgaaggcgtgcccctgcgctttgtggcctttgcctgacgagggcgctcccgctcctcgtcggaggccaacctcctggatgatgatttgtttcgatcggaaggtgatgccgcgggaattggtgatctcgctcgtgccttggctcctgtcggttttgatgtttcctcaatgacgggcttgggagccggcaagaggaacgagggtatgttgattttgatcatgacaggggagagcgataaatgtccaccactcttgcgtggaagacccttgatttgctcagaggtgagtagcctgcaaaattccgaggagcatgctggctgtgatctggttgacttttcggcgaatgatttcgtgggtcgctttcccgcggtgcgtcctttggtgcttgcgtattttgccgtttttctccttaatggtccaagggagtgaccagaacaaatgagagataaagaagatcagaggcgggaagaaatgaataaattgctcacttgaattaagaggcgtccctgctgcgtgttgaatgaaattaaattaggcacatcctcactcacccagtcgccttgtaccgaggattggcgtctgcttcgctaagcaccacactttcagactctgccgctgacgacgacagatccgaatcatcatccgagtccgaggagtcattgcctagcaagtctggcggtgctgtcggcatttttcctggctgcttccctcccgtgacgggtctggtcgacacgggccacgctggaatggtcgggctcatgggtgcaggcaatttgatcattatctaaaaatgtgaataacgataaatatacatgcgctctcttcgcttcacgttatgggcagccttggaatgtggagccatcgtttccataacagctgtaagcctacctccaaagcacctcggaccttctccagaggtggggtgggaagactctacatcaacaaaagttcaatgaaggatcggatgcggatatccgtgtaagtcttgctgccttgtttctcatccgagagggtgagacgcgcttgtctctcactccttcttcctctctgcgagtcggatagacaacaccttacctgacgagcatgcctgcctgagatccttgtgggcctaaaggtgcgagatgagattgcagttgttaatgacaggcatgtacagaatgcagaaagggtgagataagggacgagcgttcataagaacgtcgggtgggaaatcggacgggtgcatgaacgcacgagtgcgacgacatttttctcttttttttttttttttttttgtcaggggcaaacatcggatgtgcggatctgtgctcaagagacacaaacaaagccatcccagaaagatcgtagtcccgacgaacaaatagtattagagtcgtacacacgtccccccatggacaacaccagattgaatacatctgcccttgcacaaacatgctctcccacatagcagattgcgcattttctttttttttctttttcttgtacacagataacctgatcacccttgatgtgacttacggaagaagtggtccatagccagccgcatatccggacactgttcttggcggggtcggaggcatggtccagtcgctggctgaattgggacggcccgatccagaggatcggtccttgaggccccaagggcggggcaggaaggtcgcgtactcttggacatgcagcatagcatctggtcctgcacccagccccttggatgtccattggcgcttaaattcagcaaccttattgtccagatcgtcacatgtggcgggtggtggtgggggggcatgcgtggaggacggcggcggggtgttgacggtgtgcccatagctgttgctggacgcactggaggctgccagcgagctgggactgggacttggcatggaggggctaggcaatgccgcacgggcagacgctgttgaggtcattcccgttggtgcgatatggaaggcggctttcgttttgttggcaggaaaaaaataatgagcctcagcacgcaaggtcaaggtggcagagcgggagtgggagggaatgggatagaggctagagaatagacgcaggaggagcaaagggcgttgtcaccagagtgctggggtctgtccagtgcggccatgcacgactagacgtactggccaggagcgtgtgattcagagacaagagacagagcggaaggtgagagaaaacggcggtggggggggggtgtaactgcaggctggagtggggtggaatgtgcaggagacggtgcgtgctcggccgtgtgtccgtttaggtgttcagaggtctgcaaggatggaagggaagcaatgaagcaacggaatgaggtgacgagcaaagagagaagagagacgactgattacttgagggacatcgaagggaaggggttcaaggcaagacaagaagacgggcgagaagacgcaatgagcacggcgagatggccaaaggagtcagcgaataaaaagaaggatgcaatcaacagctgaatcagaggctgaatcagagcagggaatcaagcgggcggatggagcaagtgaggggagtgagggggcgaggcaggatccatcagtcgatctgcaggcgagcggacatggccttgagcagtggtcgaaggaagaggcaacgagaacagagagagcgagtgcgagaaagagaggaacaaaaggaacggaacagagaagagagaagaaaaaaaagggtgtgggagggagagagaacaaaaaggacaagagggaaagaaaaggacgtggggtttagagtttggaggatggaggtccctccagcgcaaccttctttttcgcagtgttcattacacacagacagacatacctctctctcactcttgctggatggattaaaagaccactgcacaaaagaggcgacaaccactaccctattccttgctcgcaatgagatgaaaaatacgcatcgcaaagagacacctgtcttacgtgcatgcaactcgggcatgaaaaaaaaaaagcagtttctccaagcggatcggtggatcggtggatctggtccgcggggttatgcgtgggctgctggactgccctcgtcctgcaaaagggggggcgggaaggaaggtgcaggtttgcatggcaaatcgagacagagaagccgcgtgcaccaaatgatgccatgaccactcgcgggctgccccatcgttttctcgtctagcaccgttttctgttaaagaatacctcgtctcgcctcgtctcgtttcatctcgtctccagggcacatcttgatggcccgatggccacgcgagaaaatcagagtttgcacaataacgttttgtacccaaacattgggcactgtgcccggcatgttgctgcacacggctgatcccctccatcgttcgcaactcgtttccaggggacaagggtggaatctatttgcatccaacatcctgtcgaccaaagaagcactgtgggcgattgagaatctcagcagggcattccaacagcaacgagccctcatctcctcgttctgaggtcaaatcgatattggaatctcgccctcttctccttcccatcattctctctctctctctcttggggctaaggcacactcactgtagggaaagatttaaaaaaaactatataacattgacactgcttcgatgttcaaacgagtgaaaggcttcctcttttctctccctcttgccctcgtctcttttcactctcttcgtgcgcgcacgcatgcccactttctctctctggttttctttcgttcgactcccccgctctcctgcttctctattatcagcagtgaaatacgttgaactcagcagctcagatactaggggacgcgttcatcgtagtttcatccagatcttaaagtccgcctattgctgtgcctcgcgcggggacattgagaacagacttgacagtgttcacccttgaacatcccatcatggccttgcatgggattctaccggacaatctgctactattcgcccgttgtcgaggacaccttctcatccttgctccatattccttgcgatcgcactttgaaagctgctaaaccgcatcataccgtaatccagtgtcttgcccccccaccacattcctctcgccctcgttagccctcccttcctgacaaagtccatcccactgttgcttacgcagcaataccattacaccatttcgccctccaagcatccacaacaacactacctattatctcaactcctatcactcgtccactgtcgcaacaagtgtgcacaacactctcgtcgcactctggttttctgtcttcctagctattggtttcactcgttgagggcaaggcgatccaccaacaagtatgaacaccacaagcgactttgattcaacgtctaatcgccaaggatcagagcagcctaacaatccattgacacgaccctatccggcattaaggcccaatgcgtctgctagtgcatacttttattcttctgcccctgcccccacacacgactccatcaacgcagacaattctcactcttacgcatttgcgtcttaccacactcatggctcagccttccatggtgaacgacctgcagatcctggttcgcagcaagagctcaccactgtcatagacctttatcactctcgaaacatccatcattctcaggcattcagtcagggccttcccgagcagcattttcactcgcaaccacacctgcacccaccccttcaccagcaacacccccatcaagaagcgctttaccatgacccactccagcaccatcgacacttcaaccacacctcttcgcatacgcgacaaactgaggatgatgaggatgaaaatgataatgaagatgatgatgatgacgaactggactttgctggtacgctggatgaagcgtcagacagccaagagccattgcatccattgccctcacggtctctggcacggccatctcgcccccttagctcatatgaacttcactccaataattttatatcgcaagatgaattccgcatgctggcgaacgactacctcatgtctctctcacccaaaaagagagagaaggctctcctctccaacgccatgtaccaaaagatcctcatggtcctgctgcagccaaagaacacacaagtgtcgacggcccagtttcggttctgggccaagaagatgttcaccatgtccaccaccgagacgcatcatgttgtgtgtcacgcagggaaaccagtggcgaccaaggaatgtctctacgacgttcttgtctactgtcaccgcaagagttctcacggtgggcgagacaagacctcggctgaggtatgtctctcagaagtggccagggtggcaacacgtaaaaaaaaaatgaatccactaacgtttttacatgttacgtctaggtacgcctacactactcctgggtacccaaagagttgattgctcgattcgtgaaatactgccccctttgctcaagtcgacggctcagcctgcagcggccactctcgctaacagctctgtcgagtatgggctatggggcctcctcttcatcagcagactttagttcgcagacggatttgtcacgcctccaggatagcgacgcctccttccatggtcgcccaacacatcttgggggctacttggagatgagggacatggagcgtgtagacccttcgacgtcaaactcgcactacgtctaccagccggatcaacagcaagcgcatcaacagaatcgacagcatcctcaggatcagctttacgggtcggcacctcaggcctctttacagcagtatcatggggctcgtcttcgctcagagcacatataccgtctgcagcagcagagggctcaacacgacctgttaggacgatcttgtcccaatctccggtatgcgcagcattctcatcaagctgatccttcagtgcagcctctcgcacagcgatcagccttgcacagccagtactttgacatggatgctggtgcatccagtgcatccgccctggaatcttatcgcgttcagaggtggaatgaggcagttggggggcacgattctctgatcacagacggccatgaagcgctggcgcaggatgagggtcgctggtacgaccagcagaacggtctttcgtggagcaatgagggcgcgcgatctgcagttcaccccgaccacggtatggacgacgatcgtacgcctagtggtcttgttggaatagcgcaagaggtcaggcgctttgaccggcggaatgtttcccgagttcctggtgcacaacagcatgtcccttcacagcgcctacaagaggggtctggttttcagctacgtcctgctcacgacctctacgaatcgttgcatcaagaccagcccttggatcaaggatcgcaagatccagcggagagggaattccacgagatggagggtcgcgtctactacgaccgcctctcttctcaaggcgagatcctacgtgcacttggccagagtgtgtatcctttgaactcctctcgttctttcagtccctatgctggccatagcaatgcgccacatgtcgctgcccctcagggacctcgacatgccagtcatgatcgcttccgtctagttccatcagccctcttgagcggcaacgttgaagaccttcatcgccatcgtgattcgcgcgatggtgcccgtgcgatccaagggcaaggcgccccccgacgccagttcaagcacgaggacaacgaactggagaacagggagatgacataactcatacccttgctgttgctgttccacagtgccacctcccttactctcaccctcacaccctaacacttactattacccttatccttcgcctctcctctatcccatccccaggtcaacaccactcacccagcatcataaagcattgtcgttcagtttcaatcttgttccgttcagttttgctgcgccatgtccatgaacctactttacatcattccagtggtgttcgttagagtgtcttgcctggcatggcatggcatggcatggcagcgttgtctgttgagttttctatttccagcagggtgtggccacgcgtgtgcctctctctctcgccacacacacccgctgctgctgcagcatgatgtttatcgtcgacaaggtgtgcgtgccacttttttttttctttgttatgaccaggtgctcatgatcaaccccctatttctgctcagttgtttgtccctggcacattttgctgcgataacccgatgcgctgtggccctcgctcctctcagtccttttgtttcttcgtttctgaccattcactcattcattccacccattgcccattgcattgcattgcacgttccctttatcctccctccggcatgtcccagaccacccttgcagagctctctttatccctcagccacgtccagtccttgctcaaacagatcaccgccgaggtcaaggttctgagcgagggcgtcgccgttctggtggagcaagaagaggccgaggacctggaggaggaactcaactacctggacgtcgacccgtggtccaaagtcaacgacaaggacaaaaacaccgccgtcaccgccagtcgccaggacagcatccgctctctgctccagcgcaaaccctcgacagtcaaggacgagaccaaggcgctcgccaggatcctcagtcaaaagaaacgcgcaggcagcggcgctggcagtgaaagcgagacagagaagcacccgtcgacctcgaaatggcacgcgtccacagcgttgcaggatcaggtcatcgacgaggactcggcgtcgtcagagggctcggcgtcgtatctgaacgggagtcgcgagtccctgggcggcggcggcggcaagcaggaggactcgacggtcaactcactggcatccacaacgtcgtccaacgccaccacaccgcagcctcccgaggctgagcgcgtgccccatacgatcagtgtgcagaccacgcagatgcccgcaaagttctcggtggcgatcagcaagcccttgacgcccttgagccctgcgacgcccgtgctgtcgacctcgtccagtcaaggctcgattctcagtgcgatgaacaacctcaaccaccaccacagtaacagctcatctgcaggaccaccccccttttggcgatcctctactgctcctagcgtgaccgaggggtcacgcccaaactctgcaggcagcaacgtcgattctgagggacactcgactaggggcaacatgcaggtacggcgaaaggacaatgccgtccatcctttgctcaccacttaaaaacaggaaaagatagtttaagctcagggaagtcgttacctgacagtaacctcctcttgctatgtctagtcctcacagcgtcgatcatggcaaccagagtcgaggacgtctcaagactcgacaccctttgcgcactccagcatcaaggaccgctacactgtgagttacacactcctgtcgagttcttcaatctaaggaatctgagggggaaaagaactctaacttgacttgcttctaacgctaacacgccatttatagcaagcacttcggtccacgtctcagggcgctattctccatccgcctgtgggccgagacacgataaagtctacggtcacggtcaagtctgccacgcccctggtggctgctcaggtggaaaagacggaatcagcggactgcttcagcaaacttggcctgtcgccagagctcctacgcggcatctacgcctatgggtatgtcgcatcgcatcgctgaggaaggtctgtgagtcctcaggcgcaatctcacacccataagctaatcagtcttaaatcacacgtatcctattgctacatagtctcaagatgccctcgatactccagcagcgcggaattccaatgatcatgtccaaacatgatgtgcttgctcaagccaagcccgaagtggccaaaacattgacctacgccatcccgttgcttcatttcctgaccctacctgctacctcgatccatcctcagttgctcatcctctgctccaaccacgatttgtgtctgcacgttcagcgcgtcctgctggctctggctcgattcatgcccacaatatcgtgtttaatatgcgcagacggcaacaatgcgacactctcactcgggaccatctcgactacgcaagtcaacactgcaggtcatggaggaaacaccaagaacggccatgctcgtgctaatggatatggcggtactaatggcgctaacggcgttgggtccaatgcagagccattgcctgtcatcgcagcacatgtcgtgatcgggacacctggaaaggtcttgaatctgatcaagacgaaacagatcagcatctcagcccttaaagtcatggtcctggagaacgcggacatcctgctgtcgacaccattgaaggaggccaccatcagcttgctcaccatggtgagggtccccagcattacaaatacaggcactgcaatcacggcgtcgtcatctgtggctggaaccaacggccatggttcaggaacgatatcaccccctacgtctgtacccacctcgcccgtttcgatggcggttgcagcgttgaatggaaggatcatgggcaccgcgggcagtggcatcaccaatggcgccatgggacgcacccctggaagctatggtgattcaggaacaagaccgcgctccatgtctagctccgcgccgtcagcattctcaggcctcgcaaccccgaccccgacgatagcgacgactatgaatcagccgcagctcttgttcttctcgacggaggtgccgcctcatgtgattgactatgtatatcagtactccaatcaaccgaccaaggcccttgtgaagggccacgagctggccctcaaggggatccttcagttcttcaagtacttgaccgtggaggacgaggagtggcgacttgaactactttgtgagctgatcgaggacagtggagcgaatcggtctgtcgtgttttgtaaccgggatagctccgtggagcgggtagtgcgcaagattcgagaacgcaatggttctgtcatcggagcggtaaagccatgcattttttgttcattgtgcatctctgccaacatgccttgatcgcgatgcctccagtgttaaacatgttttctatcacgattggtgcgttcatagtactcggacatggacatgactaccaggagggcagctctgggaaggttcaggaccttggcgccaccggctgtgtttgtgcttacggacgaggtggctaaggatctcgatatactgtcggttccgttggtcatcagctttgagattccgagcatcagccactatattccacggtaaagaacagagtcgacgactcttgtattctcgccatcctgaatggttcatgataactcaaacagagccatgcactgaaagaccttttcgtttgattttccaatagcgtaaagtggattgatcggtccaacggacgagtgggcgttaaagtcaacctggtcgacggacacaagggcgagggtcaggcattgcgggctatccaacagcattaccggacgactatcgatgatatgcctgtaagactcgcgaaagccttttgcttgctctgtctgtgtttgtttcccacgcgtgttgttaatgaaaactatcgtttttttttccggacggcgtgcagttgaacattgcagatttcattacaaattagacactacaaacgagcagcggtatagtcgaacagactggcaaaggagtgtgaacgacaaggtggtatataaataatgtaaaggtttggcaggtccactttgcgaaagtgctgtcatcccactaaccattcctgctccattttcaataccttccttgactgatttgcggctttattgatcgcctttgaaatttttttttgatgtttcttttttttttttttttttttttttttcacctgtgggaaccaaaggtcgggaagagtgtccaaagttttcagtctacccgctcctgccacgttactttcccgttctgatttccgtaaagatcgttcatgtgcccagtctggtgaaactggtggtggatccctgatggcgacacgcccgaccctgccatggcagcggcagcagcgaggccactgctggagaaggcgcccctcacacgaccgctcttcttccctgcgatctcgaacgtgttgtttttcacctccaggaagggaacttttgtatgcgccgtttgttgtcctggctgaaaggcctcgtgcttttgggattcaaaggtccaccgttcactcatctcgggatggatgttgttcgcgaggttgaattcttccattgggtttgcaaaaactgctgggctacgacttgtcatgagaggacaattgtcagaaagggaaaggtcgccgtctagcagtagtgcttctcggcaagtggacgctctacagcggtaagaagaaaaaacagaaaggacaaaacttgcttggaaaagacgggatgagagatcgaaggagagttttgagtatcgggatggatggtttgcttttatagcgcccacacctgctagcacggtcccatgtcagcgcccaaagtatgatagtcattcgctcctgcatgcacgtagcgggcttttgcagccacttgtgcgtctttcgtcccgtgctcctactaggtctgtcgtcggaggcaaaggaatgggaaagagggtggcccaacttttgttttctcatttgactatagggcgacgaggcgtggcgtgcggctatgcaccaagatgtcatggtgctgtagactactctgcaggaagtgattcgtcccagtagagcattgacatttgactgatgagttgcttgcatgagcccatgaagcaccaccacccaccggctatataggagacgttgacctgcgctgcgggcacttcgcgtcgtgtatcgaagctccgcatgtttcagagtaatcagtcagtgccgcggttcaggggtcaggaaggaaaaaaaataatcgcgacaccgctttctatgactggctactgacaaagcgacaactcacgttcaagactacaccgcatgtgttcattgagagggctggagggctggggttgattccttcgagatcctcctcgcccacacacacaaggtgtgccattccgaggtgaatgtcatggagtgccttatggggactggaatcttcaatgagatgttagtcaagttttggtggcggtcagggatgcataacaatctggatggctgcaatcgcactgtttcgtccctctcctccacttttttcctttctatctcacttgttttctcatttgatgacttttgacgtgccgaaatctcaggctcaggttcgcgttcggtttctattcggctgttcgttcgccttgactgttgaaaccgcaagactgaactctgtcacctcttttgaacgcgattgccaaaaaaaaaaaaaaaaaaaaaaaaaagcgctcccagtccaacacggacgaagtcgtgaggacctttgagagcatgggtctggctcctgctttgatcaaaaacatccactcgtacgggtaagggacttccaaccctgtctcttgtgcacccttcagcgctaatgggtctccttactcatgaagcgaccccttatgtttgccatatgattacagaatcaagatacctaccacctttcaacagcgtgccatcccagccatcctcagtggctgtgatgttgtcgtccaggacccttcgtcgtcaggcaagacatctgcaatctgcatatctgcgattcagcgcgtgctccagtttggatccaccaccggtcaagtactcatcgtggtgcccactcgggagaaggcacttcaagtcatccttcaagacctttgctctggcatggacatccacagctatgcgaccaggactgccatgatggcgcgggaggatttggcacatattgcggaaagcaagcctcgtgtgctcgtgggtatgccgggccaggtgcgccttgctcagcttcgaggcgccctcgctgtggagcaggacgtgcggatggtgattctggacgaggtggaggaaatgttgtcgcgtgggtttgcggacccggtgggagagctcttggcatcgctagggccaggtacacaggtcgtgctggtcttgcgtacgatgaccccggcggtcgcggtcctgatggctaaattaaggaccggtcatgtgcagatcgtggcaggtcatgaagacctcgaaagtgaaagtgaggcgtagtaaatcttgttttcatgtggtaaatcgatatcgagtccagaggctgatggacaggactgcgacgcagcaaccggctcgttcgaggtactgaggggatcttaaatggaataggctgttgaaatcgaaaaccagaccatcaggtctcgtaagggtgttgacgatagctactcaacctgccgcagcccaagagccggtatgtggtatggactgtgcctcatcgcgtagctactcgcgcgcctataaaaagagagaggctcgtgctcaagagtattttttttctacaacacaactatccaacatgaccaccaacaatgatcaacaggccaataatggccaaggagagagagagagggagaccgaggttcgtgttcaagccccacaggccacaatggttcgtcctggtcccttccacctaggactgcaggtcctctaaccgtagacataatatttctgacgtgtcatagcccgaggcttcgagggctgtcgacagcttcgagagcatggagctgaatctggaactgctccgcggcatctactcattcgggtacaggaaaaaaagaagtgatgggcttgattcttgaccacttgccattcgcacacgttctccatcctcctctctgatttcaccttttgtatccaacctccccccccccccatctagattcgagcgaccatcctacatacaacaacacgccatcccccccatcctcaaaggccacgatgtcattgcgcaagcacaatccggcaccggcaaaaccgcgacctttgccatctccatcctccatcaactcgactactccaacccccactgccaagccctcgtcctcgtccccacccgcgaactcgcccaccatatccaacgagtcatcctcactctcggtgaatacctcaacgtccaatgccgtgcctgtatcggcggcgtctgcatgcaggacgacatcaccagcctcacgcagggcgtccaggtcgtggtcggtacccccggtcgcatctatgacctgctctgtcgtcgagtcctcaaacccaactcgatccagaaattcgtcctggaccaagcggacgagatgctctcgcgtgggttcagggacatgatccgcgatatctttcagctcttgcccgcgaccgttcaggcgatcttggtctcggccaccatgccggacgaggtgctcgaagccacgactgagttcatgcggaacccggtcaagattttgctcaagacggaagagaccacgcttgcggggatcaaacagttctatattgatgtgaatcgggatgaatggaagctggagaccttctgtgacctgtacgaatccatgacgatcacccaggcggtggtgttttgcaacacccgtcgccgcgtggaatggttgagggatcaactgaccgagcgcgggttcacggtgtcggcgctgcatgccgagatggcccagccggagcgggagtcgatcgtccaggactttcggcagggccggacgcgtgtgttgatcacgaccgatctcttggatagggggatggatgtccagcacatgtcgctggtgatcaattatgatctcccgaacaacaaggagaattatatccatcggatcggacgtggaggccggtttggacgcgttggggtggcgatccattttgtgaccgaggcggacgtgcctgcgctgagggagattgaggcgttcttttcgaccaaggtcgatgagttgccgatcgatatcgcgaatcttttgtagaagtgcaaaaaaaaacagtgtaggtttttgcacagccattttcatttcttttcttctttgtttgcgttcttctcctggcacttttgtcatttagtgtatatcttctttttttcacaacttcttttgctttttacaactcttttcatagcaagcatagcatattcatatataaacgaatctttaattggcttcttcgtaaaagaacatgacctcaaagtgaattagatatcgaaatgggtgaaaagaacagcaataaaaaaaaatgcgtctttctgtgtctgatggtatagaaactgccattgggcatgggctgaagggacaggtggggaaatcacgtcgtcacccaggcagtgaagttgggtaagacaaacgtagggaaaaagagcgctggtgatacaattaatgtaactggacttgatttacaagggcaaatgcaagcgagagaagggaaaagaaaatggtgaaaaaaaagtgattcctctagagtacatggatgggatcgaaatgtgtgcgtgtatggggaggggtatgatgtggaaaagttagtgtagcaaaaacggggaatgaaaaatgggttacaacaataacaacaagatggaaatgaaaagtagaggtcaagacgagaggcgcattgccaaacgtgagtttttaccacacgcgatcctcagctccaaagtaatcgcgcgattcgccatcttcacccgcgccacgtcgagctccgccctgaacaagtcgggtcttgacagtggcatggcatgggtttcgcagatagcggacggtgggcgtatctgtaaaatcttgcgctcctcgggtcgagctgccgttcgtggccgcagcactctcctcaccttcctcggaaggaatgctcttcatgggcgaggcacggccagaggggtactgcgcaagggcattgaagttcatttcggaggcatcgactgagtaacgacgcatggacttgagcatccgacgacggtgggcgttttgctccagacggttggcaccgctctggctttggttgttgagcatgtcggaaaggagggatcgtcgagcgattggcgcagctggattcaactgttgttttgggaaaaaaaataataatacgcggatattgagttagaccaaaatgcacaacgtgaaaatgctgtatacaatgcgcaacttcgcatagtgctgcatgccctatgcctcatgtacgatgatgaagaagatgcatcatgcacaaacaaagcagagctgcactaataaacgcgatggtggccgatggggttggcgaatattttttctttttttttggtcaggatgagccgaatggggtgggcgtcgtgtattgatgtgtgttcacgcacgcgcgttttttttttttttttttttgattttcttggtattgtactcccatatctggcgtaaataagctgatgttcgaagaatgtggttgctgatgtggtttttgtaggcacccaaaaggcggtgcaagcacaagcttagcttggcagtcgacgaaaaaaaaaatgggaatcacgcattaccttgacgagtttgccaccaagagatccggtggcgacgctcactacgccatcagcgctctcgctaccagaggctgaggcctcagatgccgcagcattgctgatgccagcgcctgagagggacttttgaagctgcgagatggagatgttgccatcgctctttctggagacatgacgcgtctggacaggagacgcggaggagccaggggcacctgtggtaaaggcagtggtcgcaacaccgtcctccgagatctcgatggtgtcatagagacggttgctgaaggacgggtggtcaaagtgatcgtgggcgggggctactgcaagacaactcatggagcggcggtgataatgggccgaactaaagacaaaaacaatcattcaagggcaagcatttttggaaaaggaaaagataggacataatggtgcattgaaggggagatgagcgggtaaagtcaaaaaagcatttgaataaagcaagtaggtgaaaaaaaagaacggcggacagagagagggtggaggtggaggttgaggagtcaagagaaagaaaaaaaaaagaagcgagcattgcatggattgcatgaatatgtggcatgcgcagatcaggtataacaaagccacgggtacacagacagggccaggtaaacaagaagggcaagggccaggcagagcacacaaaagcacgattgatagttgcgtccagattcgaggtcgtcgcggaaggttgccaaggaagccaatgcatatcaaggaagaggaagaagagggttgcaggaaataagggagggttaatgcgatgcactaatgcgtagcctctacgcgatgctaggggggcaaaggccctaacgcgcctgcatgcatattgaacacatgaaagtctaaataacccgattttcaacgtacccttgtcgcatgttttggctcgatcgagcaaactggtgggtgctttgggcagtgttgagaagcatagtgaaaagtggcgttttgaagcgtttaaactttacgtaaaattaggcggatctgaagagaagtagtagtcggagcaaaggctggaagtcgagggtctctgatgtggaggtgagggccgttacggatgcgttgatacgaaagaggaagaagaagaagaagaaagcgtgcggtgtgggtgaggtctggtaaggctgtgaaggtgttgccgtgtgggcgtaagggaatggtcgagctgatccaaaaagactagtataaaagcatgggtgaaatgtgcgtgtagggaggtactacaggcagagaatcaagtgggtctgaggagactctattcgaggatgagctggaggaaaaaggaggaagagagagaggtaagtaggagaggaggtaagggaggaggagaggaggaggaggagaaagagaggaggaggataaggagatttgcggatgagagatccaagatcagagaaagagaaatagagataagttggtgagacaagaagagagagacgcaaacagggccggcgatggtctgatatttatgtgtttttcccttcgttcgacaccgagtggtggaggcatgcgaccgagatcaggagtgagatgctctgtgtccatggagtggagggaatcgagagcaacaaacaaggaggccgttgaaaagggggagagatggaatcaaagctgaataggactgaattgattgaggtggtccgcccattcatttctgcaagggcttcttgttgtgtgctacccctctttccctctgtccctcgttcgcggtccaacgtccgagaagcaccgtggagatgctccataccctaaaaacagaaccgattaggcctatgagggtatcatctggaagataccatggctaaatccgagagcatgggcgacatggcggctggcctgttgtcaagtggcatgctaaagtgatgtctcgaagttgaagtattgattagagtcatagaggcaggcatacagatggcgaagtagcgccacttctagtcgaacagcacggtcaaaatagccttgggatcaagggtcggcggtcgactagctcggttctgtggatactattgattcgggctgctgttgagcgtttggtggaccaagcgccttggccattgcattagccaccatccgtgtgttggtcgtctgtgtgcgtttgttcttttgtggaggacgaaggacgagcgcatcaacagatgagacagcgggtgcaaggaaatttaaaggagcacaatagttgaaacgccaggagacgcaaaagcacacaccgggttttcctgcaggtgggtttgtgtccagagatgcactcagatgcatgcacagtccgcttgtgtttacgtttgcatgtccgtggtgcgtgtggtgcgcatgttttttctggccagtgtgtttaatgtgtctgtagtatggatgtggtgtgatccctgaagaacccagctggggtccattaatggatatttggacccgatgtccaggtcggtccgtatgaatggatcaggccgaaatgcaacccttgttattttgtaagcgtgggctgaacccgcgcttacttattaatcaatcttttttattttgccgccctcaaggcgaaggcaatcggaggaatagtccagaagggcgcagtgcagtaagacgcctcgaggtccgaaccgatctaaaaaagaagggacgagaacgccgtcaatcgtggtggtgtccacgatggccctcgtttctccttgcgtcagtccaagctactcaattactagtttaccacctctgctggtgcgacagaaccaagaaaagcggtgccattcgcatgtttcatggaatgcaggacgaagcgagcctgcattttgggccatctggcggcatggtatggtattgtaataaacagctcatgaatgctaaaaaaaaaagagtcagagagaataattagacaccaacccgccaaaacaaaaatggggtaaaagtgtataccaattgccgaacgagccgtgtcaaacatttcgagagcaatgctgttggccgcgcgacgaaaagagaaaaaggacgctaagatgccacagggcagattgaatgaggtaaccgacagtctactcagctttttcgcctgtcctaccatgctgctgcggattagtttattctttctggactgcaggcaagaaaaaaaaaaaaaaagccagtcagaactgccccggcagaatcgcatgcatggttgcacaagatggttcttgcatcgcccccgcgccccaccgctccgcgctgagcgatttgcgaacttcgggcttggggatcccccctcacctttgctgggcagccatgtccctgaattgtttcatcccgagcattctattttcaacctttttttttttttttttttttttttttttgcacatcttttggctctcgcgccggatggtcattggtgatctcgatctctctcttgcgcgcgctcacttattatttttctctgtatcgagatttacatgtttctccacgagatcttccagataccacgcgccagagtcgtgtgtcgcttatgtgtctcgagtgagtgttcgaaagatagaaccaaacatagcatgcggcctccttggatccctgctccccgtgtgccttttctatatccccgcttgatcatccgcctctgcgcaacactaaagtagttcagaaacgaagcgctcgtaatcactcacagctaaaacgctaatgcacggatctagagcgcattatggaacacatcaacaaaatgcatgcaggataactgcccagatgcatgaatctgtgcagatttctttttggtgaacgttgggtcaccacatccctgtccgttcattgtctaaagcagggagggaagtgtgcctgtgtgtgtgtgtgtttagcgttcgattggatagatccgcccgcgcgaacaagcgcaattgcgtctagaggcactgacatctctctcgacggggtccaacggtcgcatcatgcaacaaaacagtgggtattgtgtttcgtctgtgtagcgtgactttacatgacgaggaacgggcctcctgggtcctttttgagtacggttgcgagcttggagaacccttgtgttgcattacacaagaataaacaaaaaaaagaaagctttggccacctcgtctccgtgctgttgaacagcaggacaaagcgccgaaggctcgttcaccttttttgccgccatctcttttttccctcgctttttttttctctctctcttgtgttttgttgtgggtgcacacgaaacatggggcggggaaaaacccatcccgtttttgcatgcatgcgtgattgtaaagaataactcagggagcgagcttcaggttcagaacaccaaggcgctagccaaaacgcggcgcggcggcaaagtccccctctctcctgctgcccccactgtcctccgagcttttttgagtttgtgaaggggtcctgagatatggggtttgtcaggacgggtccagacccttttcgagggtcttgctcggccactctcccctcctcccctgttgcttacagcatcattgcttggatgtggtattgtggactctcttctttccctctcagcaagttcctttcacccatcccctctttttccctttctctctttcactctctttcattagccatcactttagatgttctccccccttcccttaactctaaaacgtggtggatatcttactgcaccattgaaccattggtagagaacgaaaaaggcgtactggcattaaaaaaaaaggagaggcaaaagaaatcttgaccaacgtcccgattacttctctgccattgatccaggtgaccgacgcaccacgcccagattcggggaaatattcatgtagtcatagactagacgtatgcgacgaagcattaataaaggcacgcgttcaagcgtgcttacaaagacatgcagcctatcgacaccatctgggagatttagtatggagatctccccgagggaggttctggacgcagtagccccgtggtgacgaacgcctcaaggaaccaaccaaccgcgctgattccttcatcgctgataaccctcatgcatatcacaccacgcgaccgcgcctccccctcgcctaaaactctgttttctagtgccttcattgtactttaaactatgtgtgtgggggagacaagaatggtatcatgcaactgaaacgctggcgcaaacgatccactaacgcccgactatctctttttgctcgccttcttcttgcgcagtctagcccgctcgttcggggtcaggggcgccttgggcgaggatgtgccagaagcaggtcgcgacgaagcctgcgaattctctcccgactctgtggtcgatgtggttgtcaccttcagctcaccctcacttgtaccttcaccctccacattcttgatttccgaggtcgagggctcaatcacgacttgggtcagctcagcagggtccgcagccgattctattggtaagttctcctcaatggctgcggcggtcgggctggtctcggtggaggggatgttgacaatggtctcctgagcgtttgcgccgcgggatgccttgagttgtttgcccttcttctttgctccagagccatccgatttagcatcgtccgagaaggctccctccaccgtcaagtcgtcggattcatcccggctctgatgcttccacatgccatagtacacgcctaaataagacgtcaaggtgaaatgaaacgtatgtcagaatgaatgcccaccatgtgaaagcaatgcaatggacctgtaaatcactcaagacataccttcgcctcctctggccagcgcctgttccaccaactcctcgtgagttccttgctccacgatcaccccgtccttgatgcacagaatcaaatccgcattgatgatagtgctcaatcgatgcgccacaaccagcgtcgtcctgttctcggtcatacgcgccagcgcagcctggatctggctctctgtttctgaatccagagccgacgtggcctcatccaaaagcacgatgggaggactcttcaggatcgtacgagcaatcgccacgcgctgcttctcgccgcctgaaagtctcagcccgcgctcaccgaccttggtgtcataaccatctggaaagcccacaatcctgtcgtgaatttgtgccgctctggccgcctcctcaacctcctccttggtcgcagtagtacgtccatagttgatgttgtagtagatcgagtcattgaagagtacagaatcctgaggcacgactccaatctgctcccggagactggtctgtgttctcctggcaatatcctgaccgtcgaccaaaatccttccagaggtcacgtcgtagaatcggaagagtaggcggagaatggtcgatttgcctgaacccgtcggtccgaccaacgccaccgtcttgcccgaaggaaccgtgaagctgacattcttgagtccggcctgtggcgtgtcgtattggaagctaacgttctcaaacaccacctgaccagacgagacgatgaggggttctgcgcctggggcatccttgacactctgattctgatctaaaagcttcagcatcttttccatgtcgataaagttttgttgaagcatcctgtagtaagtcccgaaccagttcaactatgaagcagattacgatgagttgggtgagtagggcattaaatacagcttcggctctaacttcagcaaaggcgacattgctaggaaactagtcatcacttacgggttggtacagctggttgaggtacatgatgaacgcaacgaacgcgcccactttccgtttgccctgcgaaatatcataggcgcacagcaagcaacctgccagcataccgagcgtaatgacaagggactggacgagattcaagagctggtatgtgacctgactcttgtaatcggcaagcatgtacttcttgatggcttcccggtagcgcgacacctcaaactgttccgctgtatagtacttgaccgtctcaaagttcagaagcgaatccacagccttggcgcgggcgtcattgtcgaacgaaatcatttcccgtcggaactgtgtgcgccactcggtcatgacgaccgtgacaacgacataggcgaccatggtgaccaggacaatggcagcgtacgttgtgttccattcgcggtaaaagtaacccacggcaatcagcacatccgccactacgggcaccagttgaaagagcaccgtgctcaaaagtgacacaatcgaactggtgcctcgatccaagatacgcagcagttctccagtcttgcgattcagatggaactgcagagagaggttgtggacgtgctcgaaaaaccggatggtgagtgtgctgttgctgtactgttcaatgggaatccacgcccatccacgagccgcgttcaacaatcccgagcttccctgaagatagcgcaagaagacgtagagtagaatgccggcaacatcaaacttgcctataaacatgatggtgtagatgaaagggatcagaaagcagccggatatgcatgaagttaaagcaagcttgacaggctaggccgcgccaaggtgaagtagcatcgatagtacacttacgatccccctcggacaaaccgtccacaatcttctcggtctgccaaatcaccagtacgttgacgaatcgtccaagtccgagaaacacaaaggtaaggaagatcataaactgcagccacttgtcatccttggggtaaacaaacggcagcagccgcttgacctttggccagaagtccttgaatgcagaggcgcgttcttccttttcctcgtccagctttttctgaatgtccgtatcggaagatgagcccatggtgggaccagatttcttggtgtccttctttgccaaaaacactgacgaaaaggtaccgtatgccccggtagtggaggaagtgaccggagtgacttcggaggctcctgcgtcaagcgcacgcagggcatcgaggtcatcctctcttgactctctcttgtagtgaacaatggagagtatggccaacaagcaaagcaatacatatcggatgccaaagatgctcacaagtgcaagatcatacttttccgcatccgagccggcacctacaagagcaacacaaagagtgcatcagacagcagtcgttgtaaccgcacagtcatttgtcagccatatcgatagcaccatctgaatggtgcactatggcctaccgtcggggatgctctcgaggtggtaccagccgatgaaggactctcctgcgagggcgagccaccagaagccatagttggcccaactccactggccgccctttccgatctcgacagccatcaggatcatgttggcagagacggcgatgaaggagatgacgttgtagaggacgagcagagtgcctgaccagacttggtccaggatagagcgcaggcatatgacggcgagactggctacgaacgagaaggcgacgatgtagttgcatgcaaggatggtcttgccgagtgtggtggccttgtgcctcacgctgtgcgcatcctcttcctgcctcgtttccgagaacaagggctggtagtaggaccgcacccggaggatgaagaagtacctgttgtagaaagtagttgggaaaaaaggaagtatatcgatgcgacgtcaggcaggtgggtctctttagaaccagactgacggtacagattaagtgtgacaagatatactccaaaggagagtgtgtacagacatatgtaccgatagatgcctgcgaggagagtgaacgacaagaggcccagggggaccagcagctctgcctggtggtggtcatgaggcttcaaggcggtgtccatggcgtctagggtgttgcggggtgtgatgtggactgtgcagttggacgcgcaggtggaggagatgccacgcgactagagcctgctgcagggatgtccgagagcagggatggcagaggtggaaaggcggagactggtgcagagagacgattgccaattaggatcgcggaccggatgtgggagcagcagagggagagcgtcgcaatgaggcagcagcagggggacagatgcagacgggggtggagaggacaacaagaagaggaaaacagtgcggagtgaatctccggggggtgttgtgtgtgtggacaacgacaaaaaaaaaagaggtgcgtgtgctcgaacaaggtttccgaaaaaacacactctttttgtgcgccgttgaggggtggagaggcacgaaaaaataatgttgcgcggtcatctcgaacactctggcccagcgctgtggctgcgcaggcgagccatctgcacctgtccgcgtaagcacatccagctgtggcctccattcctgccgtgcttctttctgcactcctccaagacggggcatgttcatggtataataaatatagtttgtaatatacgtacacggcgattataggatacaagggaagggtgcctttaggcaataaagcggaggatgcggcgaccagccttcttccacacaggcacattggcctcctgctcctcctcggacgcagtcttggccactgcctcggacgtgcccttgataatagtgggtctgcccgagtccagatcgacctccagcagtgggaccagacgcgttttgtggtagaccttccagccaatgatcgtcaggaaaaacacgggcgcgcccacaaagaccgccacaacgccctggatctcgaacggatccgcagtgacagactggtatccttgcaaaaacacaatcatcagggccagcaggatcgagatgtagcacgagtacgggaagaacggcgccaggtacggcaggtcagagagcgatcgcccctgggccttgaatgcagcacggaaacggagatggatcacagagatggacatccacgtcaacagcgccgacatccctgtgaggttgaccagccaggtgaacacgactcctgttccgaccacatcggccacaaaggcaatggaggcaatcagtgtcaccaccgccagcgagaacagaggcacgccgcgactgttgacacgtccgaaaatggccggcatcttgccctcacggcccatggccatcagcgtccgggtcgaggcatagaacgaactctgaccggcagacaacacagccgtcaagagaacggcattgatcgcatgatccgcaccgggcaacttggccatcttgaagacgatcgtgaagggtgcaatagccacagcctcattgacactcgatcctgcagcgttcagcaagttggggttggtccaaggaataacgagtccaatgacggcgatcgagagaatgtaaaagagcatgattcgccagaacgtgtggcggatggccttgggcacagccttggctgggttggcagactcgccagcagtgatgccgatcaactctgtgcctccaaagctgaagaaggcccacacgcaagtcgtaaagatgttgactgtcctatcccgagctgtttcgccgacaatgggtgctccctcaatatgccagttgcgtcctccaatggtctcgcctccaacagctcctgcgtcgaccagaattccaacgatgatgaagcaaatgcagcacaggaccttgatcatactgaaccaatactcgagctcaccaaaggccttgactcccagcagcgtgatgcccaccagaaggacaatgaagacgagtgcgggaatccacatctgcaggtcgggccaccagtactgaaggatcaggccagcggaggtgacctcgatggtcacggtgatgatccactggaacgcatagccgacacccagaccgaaaccgagagcggggtccacgaagcgcgagccaaatgtggtgaacgcaccgggcaagggcaagtacgccgacatttctccgagggatgtgacaatgaaaaagaccatgatgcctgtgccacaaggaaaaaagcaaaaagaaagaagtgcacgggggatgagttggtttgttttgtctgtgctgttcaaggttccatgcacagccaagaccgagggcgtaaagtgcttttcgtaagcaagcccgctttaatttctttctcgtctgtcactcgtgagtgtccagttgttccgctcgttcctgtagttcctgttgattgtgtttttgcactcgaggcgagtgcaagcatgcaaagaatgtctgtaatccagcgactcctgatagtctgcgctatacagtcgatggcactcacccacaatggtatacgagatcaaagcgcccagaggccctgccgcggcgaccgagcctcctgaggaaaggaagatgcctgtgccgatggtgcctccgatagcgatcatctgcaagtgcctcgacttgaggtctcgcttgactgcgccaaactcctgctcctcgctgtagaccgcattgtcgtggacgtggtcgacgtggtccacggagctcgagtcgaactcctgcttctgtacatagtctgccatagggtgaggcgagtagggaaggaaagggtgtgagagtggaagcgagagaaggaagagagcgggagggctgggaagggctgtgggcagtaacggttacccagacgatgcagcgaaggagggagtgacggagggagggagagagggaggagaaggatgggcggggggtggaggagaggaaaacgaaaagaagcggaatgatcgagggctggtgcttcccttatatagcggatttagctttcgcgctactcaaactcaaactgcagtctcactgtccagcgggatggactttatctctcgcctgacaaacaatcggacctacagtagctgcattcttccggcgaagctacttcactaggtggcccataaggagatcctctgtcaaagtgatcgctgaaagtgagatcccaatggacgcgacaacgaggaacgggatcgagaagaggtctctcttgtccttgacgaatgaaccggctggacgaaccctaaaggcaaaaagacgccatcggacccactattgagaacatccttccctcgtctattcttgccagtcttctgtacctgagcaatacatgcgggcagccaatcgtgcatgccagaacaactccgcccaagtcacccccacgttgctgagaaagccctcgcgagcagacaccttgaacacctatacaaggtttttatcaaagttgcccgtgaaagaggtacaccaacaaagatcacatcatgcgtaatttgctatagacccaccactggatcgcgcctgcgcattcttgtctccaaatcgccatctcttatggtgtctggcactctgcaactgacagattcgcctatcgttctttgcttccacgacatagccctcgtgtaacagcggcgcacatggcttactctccagagatccgactttatttcacggaaaacactgcatagtgctaacctcggctcatgccatgacaatcaactgagcgcgaggggtcagcttggcctcctcgagcgtctgctgcaagtttccgtccttgtagacactacatttaccacaaaaagcatgcctattagttcaaatccagaaaagcgcgtgctgttggccaaaaaccaaaaaccaaaagccaaaagccaaaaagtgaaaagggaaaagtgaaaaccttacgtcttgggaaaatttgtcatgagggtgaatcctggggccttgacacctctcgcgttcaggttggcatgcacaaagtcgcgcacctgttgcaatgtatgggtcggttcaaaatcgcctcgaatggaagacccatccaacatgcggacctggatctggcaactgcctccgggtccttctaccgtcttgatctccttgtgtgccgagtctccaataagtcctgtctttgcagaggtggccacagtagcaacactgtgcagacaccgtgcgcaaaagttgagaattccagacgagaggtgcccaacggctgtccacaggcgaatataatacggcgcgtcatcgactcgtcctttcgtgggtcgtgaagatgctgacgatgacgatgacgatgctgaggatcctccaagggtctgtccgcttccgctgaaggacgagccgccctcatacgtcttgatgaaggactggattttgccaacgtctgcgccgaccacacgtccgacctcggacttgttcttgaaaaagaggatggtcggcatggagctgacagagtattgctttgcgcagtcttgcgcctgatccacgtccactttggcaaagatggtcgatgtgtgcttccgctcgagtccatcgaggatcggtgccagcgttttgcacggaccgcacctagcagagcgataggacacgaaccgagaatgagcgtccggttatgacttcatttttatcaggcgtattcttcagcgcgtcagcgacagagcaacaaggtgtgtccgttcctgcataccatgttgcgaaaaagtcgaccacaacctatgcaatgttcaatccgtcaaattggaagcagtgcatgtgcagttagcgcgactgttctttgcattaatgccatagtcgagtgaaaaaggcggtcgcgcagtcctcgccctttatgtccacggaccagtcgtgacccagcggacgagagctggcgggtgagttctgcctgggagccaatgttcttcatcgctgcgtgagtgtgtgtgggggctggctgagaatggtgtctgatgggggcacagggagaagagatgattgaatagaaaaagggcgaaaggatgctctccagggggtaatggtttcgctatatcccagcagccgatgcacgcaaataagcagctcctctgtttcttcactctaaccctgtccgattccgccttttgcatccttctcgcatcagcacacaccttccgccatgccgcctagactcatcggtgagcaaagtcaagcatgcatgccctgctcatctgaaatcagcttcatacagtctggaggcttacccttgtttttcttcccgcctttgtcgctcgagatagacatcggtatcaacctgaccgaccccatgttccgcggtctctaccacgggaagcaggcgcacgcaggtgaggaacccacggatatcgatttgtcccaaacggctaggtcaggagttgttcttgaccttcttggcttgctcagtactgaacccagcgatattcaatcgtacatgacctgtagacgatctgctccatgtccttgcccgtgccaaacgcgccggcgtggtcaggatgattgtcacagccggaaacctggatgattgtaaatcagccgtggagttgatcaaggaccttggtacgcccactttagcttaactgggccgatccgtccaactgcatggtgttcactaccacctgcaactaactgggtgtggtaaacactttatcgtttgtaggtgacctgttcatgactgtgggatgccatcccacgcgttgctcagagattgaaagccatcctgaagggcccgaggcctactttggcgcgctaaaggctatgctggagaatccggacgccaaacaaaagattgtcgccattggcgaatgtggacttggtatgtggtagtcaaggcgtattcgtgttgagacttcaggattgaagactgcatccaaaccatactcgactgatcaaagggatgatcgtctttagactatgatcgacttcatttctgccccaaggagacacagctcaagtatttcgagcgccagttcgacttggcagaatcaacacgcctgcccatgttcttgcacaatcgaaacactggtgacgattttggaaaattggtctcggcgcaccggtccagatttacaaacggcgtggtgcattcattcacgggaacgctggaggagatgcagcactatatcgacttgggcctgtacattggtatcaatggatggtacgttcctggaaagaggctttcttatctgccgtgctgtccgctggacttgcagctaaccagtcgtatggacgcgcatctagttcattgaagacagaggacaacctgcaagtcgcagtcaaggttcctttggacaagttgctcctcgaaacggtacagagcaacgctgctatactggatgcaatgctgttagttttacaggacccaatctaacttgctggatgatctcgaccttgatataggatggaccttggtgcgacatacggcccactcatgcgtccttcaaacatctttccaagatgacggctgaagagcaggccatgtacaacccggtctccaagaagaaggagcgctttgaagaaggatcaatggtcaagaacaggaatgagccgtgcacgatggggtaagcggacaggacaccgttggataatgagtgctgaggtcgtccatttccaacgtcttaacatcgacgcgctttaactccctctgtagtcaagtgcttcatgtgatggctggtcttcacagcatggatcctgtagccctgtcagatattgtgtataagaacaccatgaaggtgttcttccccaaggacgagggcgctcaagcaagctgattcatgggacgcataaatttcagtggctgtcgccaaataaacaacgcgcttctcagggcacgtttgccgcacacgcttccttcttgtcctgccattcctcaatacacacacacacacacagacgcgcgacgtcgacagacacagacaccgttatcctcttgccgtgctcccccgctagttcttcccggacacgaaaaagtttgaaggcagacagctgtataagcagcaccttcacctttgacatggtacacgcaaactgactctttactgcagatccacgattgcccgcctctgctcggggccaggctacatgtcaaccaagggcgcaaagtgaatagcaagaagctaatgcaatcattctcttttcttttgtccattggccatgcctcgtcaggtggagacatccaaaatcgcgcagcgcatgaagacgagcgatggctcgctccaccccgcgaccaaactccagcccgagtccaagaagcggaaaagcaccagcaagcaaggagatcgtttcgacaccgttagcagctacggcatcaacaccgaccaggacgacgagcaggacgagaactataccactgcacgccacaaaaagtcgcccgcgcacgggaagcggcccgctgtcggcaaaaatggtggcgttttgggtcaagcccattcgagctccacatcctcaacgaatggcggcgtttcctcggctaaacgacataaggctcctgcgtctgcaccctatcagtcgtccagcagtgggttgctgagctatttcagcagagttccgctccacgaaaagaacagcaacacggcggctgaggtcgaggcacagagagcgttgagagcgctgcacgatgaggtccaccagtcggatttggacaagcctgagttggatctaggaaacagcagtgtcggcgaggtcaaagaagatcacagctctggatcgcgggcgatttcagaggaggataagctgactccggccgagacaactgagggacgaaagcgcgacagcttgatcgtactggaagaggacgcaccgaagcgggcggttgtcacagagatcgatcagcaaggaacggaggagaagcagagctcagtctcggtggcagagtgcatacccaaattgtccaaggtgtcgttgaaatccccccagacaaagaaacggcaaggggtcacgaagaagggcgaaggctcgaaggagggcgacggctcgaaggagggcgacggctcgaacgtgcaaggaccaggaccggcaaaggagcagatgaaaacagggagcgctgacgttgaagacagcacggagacaaacgtaaaggatacagcagcagcacctcgcccgtcaaagagcaaactcaagtcgtccaaacaggtcgagtccaaaacgacggcccctgatgatgaagtgacgaatgagaccaaggacgcaccaaaggcaggtcggctcatgtcagagttttttaagccaaaggccaaatcaaccagttcatcgccagcatcgacctttgaatccacacccgtcgaacaggaacttaataagcaaaagacagctaccaagggcatcccagatcaggttcaggacaaaagctgcattgacttggttgaatcggacggagagcaggcgcagactatagatgcgccggcggtattggaaccaaggcgtcgcagattggtcagagcttgtgacctggcaccaaagatccgagacgacacgactgacgacgaagacgacaacgagggcaacatcattcctgtatctacaaaacgaccctccaaaggtgcagcggacataaataaggcgagatcggcaaagaaggaggcggcaccggaaatgacaaaggactctgagccagaatcggaatcagagccagagcacaacgaggcatctcgccaattgatgaggagcttttttggcgtttcagcgagtgcgatggccaccccttctggctctgcagggtccaaatccctcaagtctgacgatggtcaaggtagcaaagctgcgtctgctgaacagccacggccagcggcgcgacttgcatcaatcaaaacctactcaaaggcgagcaaggtcaagaagacggctcggaaaaagagaagcaccttttcagattcggagcaatcaggatcggaccgaagcaaggactctgatgacgattttgagaactcgatggacgtggacgaaaaaccggacccgaaccaaaaggccatcaccgccatgttctccaaggcaccacctgccgctccgaaaacaacattcatcaagccagagaggaaaaaacgacttgcccaagcctcgcgtgagttgctctctggaggactgtcgaaccccgccaatatctgctatctgaattcggttttgcaggcgctgaggaacacgcccggttgtaaagaaaccctttttgccatccaggaacggatcaatcttgctgagaaagcattgcaatcccacattggcgtcgaggactatcagcgatcgttctttgagaacactctcacgctgttcaaatccttggatgaactggaacaaggtcggaatgaggacgatactgccgatgccctcctctttgcaaaggatgtcatgcttccacttcagtaagtttcgaggactggtgatttgttatctggtgttgattcaaccacgctctcgctaacgtgttgctccgctcactttttacaattcctagacaaggcgagacgcaattcaactctccggagcagcaggatgcagccgagtttctctccttcgtcattgatttgtttaaggacatcctgaaggctttgctgaaactggaggatgggcaaaaagagtcgggggtcgttcccaaggactgtctgcaggattgcgatatgttccagatcagcactgagaaggtgattcactgtcaaaagtgtccttcagtgtctgtacacaccgacgaaagcgtcgagctcaacatccaaatcgacgctgaacatccgacagaaatccgggatctggattggggcctctccgagacattaaaaatggaacacatgaaggacgacaaccagcggttttgcgatcgttgcaacactaaggaggatgcgcacgtgtacctctcgctcaaatcactgcccaagatcatggtcttgcgattgcagcggaatacttatctggataacaggcccaccaagctccagaatggtgtctcgtgttctgagaggatgagtttttcaaagtggatgagccgcgactacaagggacctagtcctgattatggtgaggagaagtgctgagacgaccacgtcggtactttgtttgcagtcgcagcccttgccactcaattgctaacggctcgtttgatctctgtgatgcgtgttagaactctgtgctatcattattcatcgcggtcgatctgtccattcagggcactactatgcctacatccaaaagaacgtggagatggagacagagatcatggaaccagatggagaaacgcgcatcgaaaagaaatccttccgctggtaagcgcccctactattttgttctctttagcattttcgcctagtcgcctaatactcaatccacaatgcatgcttcttcacgctgacctcaggctgcgatacaatgactcgatcgtggagccgatcacggacggacatatggcaaggatcttttctggaaacgtctctgtgggaaccagcggcaccagcagcaactctggcgatgatgactccaaggactttatgtcatcatcactcaataccctttttgacgacgacgtggcgacgccttacgtgtacatctttaggcgcgtggatgcctagttttctctgctcggattattatcttgctacgcaaaaggaactgtaaaatataccatcttgtaaaacacccttgcctcggcttcggatggcacgtcaactttgccaactgaacttccccgcaccggatgtatcatggaaaactaaggctatgataaacttgtcaaaagtatggatcctgaggctgcatgaaagacgaatgcagaacagggtggtttgcagaaagcgacactttcagatcccgtacagagagcgatcgcaaacaaaaaaaggagggaccccctttgccctggtagcaccatgcgccagaaaaggtttgcgggaaatgcatgcaatcgttgtgcacaggcaaatggcacaccgttcccgcgagagggaaggggatcatttttttgtcttccttttcctttcttttcgtttctgcccctcagatcttcgttgttcttcccaccttcgcccctaccaccgtctcatttgcacaactagatccagagctcgtccaccgcgttttgcgtccgttagagttcctgaggtagggccgtcgacttggacacagcgcgcttgcaaagcatcaaaacgagcaatggcttcagatatagacgcccttcatcctgaacggttcttccgggtattcttcatagattgacatcattcacaatctcgcctccttcgagctttgcccaaccagaaaaagagaagagaagcagaagccttaacgtaaggtacacgtttcctcacacggttccacttggccatcggacatttgcactcaacagatgtactcttgctctgcatgcttcttcaatatagatgcccatgttcgatggcctattccagccatggcggaacgcattgtccccacagcaggccttgaaattggcccagctccagttggtggccgcgagcaacgccgagggggatcccattacgttgttgttgtgcgagcaagccgaaagcaatctggaccgtatcaagcgacccaaatcatcaggggccatcgacgacgaggagtaccaagccttccgtgaagaggtggctgcagcctatagcaagcacgccaagttcatggccgattggaagtatgcggagaaggcactcgctagccgcgccaagagtgaaaaatgggggtaagctgttttgctttcgacatccacaaccccccctcccatgcgatcagggccttgtattgagcctcctctcactggcccattgtgctaccatgaccgacgaatcaatcgaaaaattttatagaggagtaccttccccgagtcagcttgccactcgagaacagacgccgtttcctgaagacatctttgatgcggatgttgctcgccctactaccgtcccggatgaaatgccacaggtgaacaagcagctcaccgataccacccagctgacctactgtcttgctgtcctggatgctgtcgcgacgacgccagaggttgaactgcccgataccactcgcaattggatacaggccattgaaaaagatcgcgacgaggagaaacgactaagggcgcttttgaagagtctggtgcgagcattcacgcgcgacgagctcaaggatgccgaggccgtcgccgaggtcacctatatggcacccgtcctagagaaatccgactaccgattcttgctgaagctctttgtcaacagtctcaaggactccgctctcctagaggtgcattcgctcgagggaatcgcccgtcttcttggttccgcccggcccacagttgaggccgatgacttggttaggaccttgcgccacatcaacgcaaacctgcaaatcacccatggccagtcggagggccatatatacaagctgacaacgaccgtctcgcggctcctggatgccatggccgacagtcgcgttgagggcatcgaacgagagaatttacaccagccgctctgtgactacctggagggcctcaagggtagcaacgacccctatcaggtctttcaagctgcatacgcctttcaggcgctactgtgtgtcccaaacaacgagtcaccgtgggaggcgacacaacggagggccggcaggatcatcaatggcgccttccagttggtgggcgctgtgaaggcgctggatgtcaactcgttcattgatgggctctgcactctgcagtctgggcttggggagatatacaatgtggccgtgacgatcaaggacgtgtactccgaagttcagtcattgcgtagcagcggaggggaactgaaggctgctctccaggacatcagctttggtcgcaagcggacatggtatagtgcactgcgaggcgcagacacgctgcttcggaacggtcagcttgccgcgttcaagaaactggtgtgtgaggcaccatgtcgtcgcgcactggctttccaatgggggttgtgtctacgcctggggaacttggctatcgatccgcagtggggcgacaagcaccgtaaagacgccgtggcgtttcttggccacctgtatcgagacgacgagtactggggccaccacgttccggtcaaacagctgatactcgatattctcatacagctgtcgcagtctactcaaagtgaggctcaaggtatgtccatatgtacagaacgcagtatactcagctcgattccgcactatcagagcagcttggccttccgtgagatgcgctaacatgacgctctgtcctctcaaaatcttgatccatcacgtagccgcggctgaaacgcttctaaaaactttgcaagaagacgacaactcggcaaagcgagccatgctcctggcctgcctaaaagcgggtcccagtcctcacccactgatggccgcactgccgcctccattgtcatccgcgctactcgatcgggcccaaggcaaagtggatgtcgaggcggacttgaagcgattgcgactcgcatgtgaacaacggcgcgtgaaggcagtgtacatcgcgcccatggccaaagccagcctccaatcaccagacacggacctgttcgacttgaaacagaaggctgacgactttctggcgagtgagaagcaaaaggtgctgctcttgctcggtgaatcaggcgttggaaagtcgacgttcaacatggaactcgaatatcgtctatgggaccagtacgaaaagcacaaaggccgcatcccgctcttcatcaatttgcccgccgttgtccgacctgagaaggatctgattgtcaagcagttgcgaaagcttcagtttgaagaatcgcagatccgagaactgaagaagcgcaagtttgtcttgatctgcgacggttacgacgagagccagcaaacacacaatctgtacgcgagcaacaggctaaaccaagaagaggaatggcaggctcagatggtgatcagctgtcgaagcgagtatgtgggcgtcgactacaaagaccgcttccagccaggcgaccgcaaccagtcctcagttcctggccagtttcaagaagcagtggtcatgccttttaatgaggtccagatcgaggactacattaaaaactttgtcgacctagaacagccgctctggagcgctgagaactacagcaatgtactcaaggagatccacagcctacgagaccttgtcaagaatccgttcttgttgaaactgtcgctggatgtcctgccgcgcctcgtcgggccagaccagaaggatctcgctgccgccaaggtcactcgagtggcattatacgaccagttcgtggaacaatggctggaacgtggaaagaagcggctcgtcgacaaagatctgagtgaacaggaaagaagggcattcgagacactatcggacgaggggtttgcgcagcaggggatcacatatcttaagcgattggcggcagatgtctacaacaagcaaggcggcaacccagtgatcgagtattcgcgcggtgaggatgcgggatcgtggaagcacgagtatttcagccgagatgaccacattcagcttttacgcgatgcctgtccgttgaccaggagcggaaatcaatacaggttcatccatcgatcgatcctggagtatggagtggcacgagcagtgtttgagccgcaatgtggagttatcgatgcggaaaagaccgagttatcaagtgccatctccaaacgtcgatgcagcgtgggttctgagtacagctttgagattgaaggcgccctgcaggacaatgccgtttcgactgagccaggtccagatctcaagtcaccagtagccctcaggtcttttgtgggtgaaccatctgtgcttcagtttctggaggaacgcgcgcagcaagaaccggtcttcaggaaactactacacgcctacatccatgcctcgaaggacgacaagaaatggcgcattgcagccgccaacgcaatcactatccttgtacgagcaggcgagcagttcaacggtgtggacctgcagggtattcaaattccaggagcggaccttagcttcgggatgtttgactccgcccagctgcaacgagccgatttgagaaaggtcaagctatccaacgtctggctgggcaagactaatctcagcgaggccaaaatgtctggagtcgaattcggggagttaccgtaccttcaagaagctggcgccgtgtcgcgctgtgtctactcaccagacgggagaacgctcatgactgttctgaaggctggaggcgcaagtgtctactcaaccattacgtgggcaacgaaatggaggatcgatcacgatgttcatatcgactcaagggtcgctttcttgccaaaaaatgatctcatcgtttccttcatcaccataccttctacgctggggagcgaaatgaaaacgaatagtcacctcgcttccaaaaatgaaacaagcgccgtttatgtctgggagacggagaccggccactgtcgccttctacgaggccataccgcacaagttacaaatattgcttgttcaccaaacgacgacctgactgcatcgtgcagcgaggacagatctatacgcctgtggaacaccacgacaaacacctgcagccgcagcctagacatcggcgatgaggcaccagccgtatccatcgccttttcacccaagggagatcgacttgcatcagcgcatataacgggaccatcacgactgtggaatttgaaaactggcactgcctcgagccctctcggagctcgaacgggttgcatgagcgtcatctactctccagcaggcaccaagatcgcctgttgtgggaatcaagtccccagcatgtgggatgtaccatccggccttgtttcatacggctggttggtcgtgggttggaacctagacgagcaacatatgtctctcgtgttttcgcccagaggcgacacttttgccaatttcggcggtggaggcccagtcacgatcgaggaaacggaacgaagaacgaagcgcttcagtttgaagtccagcgacggatgtttggatgcagctttttctccaaagggtgatctgatcgtcacaggcggcaagggacaaatcgtgcagctgtgggatgtcgattctggagtgtgtcgcggttccatgagcggccatagtggcactatccgaagtgtcaccttttcccctgatggtcgacacatcgcatcctgcggcgatgactcacgggtgcggctttggaaggttgaagccgggatgaccctcgctaattcaagcagtcttgaccatactcttgtgagcgcagggcactccctcctaggcgacagaatcttctcggtccatggtggagattcaatgtacgtctgggacatgcggactggcgcacgtctgcagtctttagctaaacctaaagagcaaatccagagtatagcgctttcgccaggcggggaccagatcgcatccgggaccatggctggtaacactttcctactggacctgaatgatgtaggcagcttcaggaagtttcgcagaacagcgctctatatcttaagccggtgcgatagcagagcagtcaaaagcatcgcttattcaccaaacggccatctaatcgcctcaggaagcaggttggcggtcaagctttgggacgccgacagagaaatcccttgccatgaatttccaggttactccgatattcccacagccattacctactcgccaacgtctgaccagttcgtctccatttctgaacagagcaaaatcgtgagactgtgggacgtgaagctttgcatgtgccgcaaactacaaggccatgatggtttcatcacaagtatcgcatactcgcccaagggggatgagcttgcgacagccagcgatgacatgactgttcggttgtggaacaccgcgtccagactttgccgcctgactttgagtggccacaaggacaaggtcaaccaggtgtattacgctccaaacggggacgagatcgcttcgtgtagcaaggactgcacggttcgattgtggagagcaatgacaggagaatgccgtttagtgctgaattgtgcagccgagtctggatcgggagtccttgatatcgcgtactcgccagcaggaaatatcatcgtctcagcagacagccacagcaaaatgcagttgtggaacgtagagacagggatgtgcatgtctacgctgcagaatgatgtcgacgaaacccctaaagtcatgcgggctgtcccaagcattcgtttttcgccagaaggcgagctggtggctatctcttcagcctgtagcaaggaggaggatgaaaatagccttttttggaaacgagaattttgggatgcagcgaccggagagagccgccacatgttcgaagatctgccaacaggactggtgcctgtcttttcgccagatggatctcgcattgcttaccccgataccataaccacagtgcgagtgcgggatatcgaaaccgaaatctgccttctcactcttcgccatgaagacaggattcacgacttgcaatattcggcaacgggcgatctcatcgcatccgccagcgcggacaggaccgccaagatatgggatgcagagtcaggggtgtgcctgcacacgattcaaaccaatcaatcaggatttcttcacctcgcgttttctccaaaaggcgatcgacttgtccttgcaactgcggacggttctccttgcgtatgggatatcaggtctgagactcttaggcgctgttttgacggccacgaaggagcagtcaactgcgtcgtgttctctccgaacaatcgcctgctcgcatctggaagtgatgacacagccgtttgtctatgggatttgacaactcgatccccctggcgcgtgttcgagggtcacactgacagtgtgcaatgtgtcgtgttctctccaacagggaatcatgtcgtctcaggaagcaaggacaagtcaatccgagtgtgggatgttgaagcaggaacttgtaacaaaactctgcctagcgccggtggtgaagtctggtgcttagcgtactctcctgatggcaatttgctcgcctcgggtaccagcaatatgtcgttgtatctgtgggacgtcgcctctggcgactcgtgggcggtgatcgaaggcacctatggaaatgtcaccagtatagcctggcgtggaacagatgacaccagctacctgatcacgggttgttccgactcatctgtccgcgtatggcgcgtctcccaaaaggaaggcaaactctgcgatgttaatctgcactggagttcatcgcacagggtgctttttgcggctggttgcgacttgcaaggggtgcaaggtttgactgagacgaacaagaggcttttgatgcaatgtggggcgtttggtaccccgcaaccacgaaagtccttcaaggcagtgagcgctgcggtactcgcaaccacatgtcgccagcagctcaaccagaaggcgatgagctctgaggagtaaggaagtaactacagccaggggaggcgtacacgtagaccctttcgtataaaccattattatgtttttgtaatatgttggcgattgttcgcctgtgctacgacagctgtgaatgaggatgacaaagaacttttttttttctcctctcgctctcacgcacacacgccctcagtgcttttcactcccagttgcttccaactcgctcagcactcgagtgctcttgctctcaattcagacagcagctgcagcagtgtccttctcctctgatgtccatgggttggtcgactcgggtccagccgaggcagccaaggtcgtgcttgtggtcgaggtcacactgacagacgccacggtcgtctcctccaccgctgtcactgtcgcagcctcaatggtcgttttcgtctcttcctgaatcacactgacatcctcatggtggtccttcttctccagcgatgactttgacgatgctggtccctcttcctcctcatcatccaccacagacccctctgcatgaacctgtgtgccctcgggccactctccagagggtcccatgtttccaatggactgggatgcaacaccaagctccgacagcatgatgggcaacacgccagcacgggcatagaacatctggagacgaagacgcagtgattccgagtacaaatcctcgatcgtgcgtgtcgagtagagaccggctcggatgttgcggataaagatataaaactcgcaagcagccacgatgcgatcacggcagaaccggtcaataaagttccactcgtctgcggtcgcaaggcggtaccggtgcgtcagcgggcctgaacggccacaggtctggcatccacccttgggagcctggtataaagcatactgggtctgaagtctctcccagagcatgttcttgttggacatggagttgcgggctggggaggggggttgctgagcagccaggaccatgcgctcatattccttgacctgctccggagttgtctcctcgatgtagcacgtgttggagcagatgccctcggtcagcttcctggccgagatcctgggattggcgccaaagcgcagacatggctccacgtcttcatcctggcaatggcgcatgaatggcaagctgtggatcttggcgagacggacggtggaactctgggccacaaactccttgaactcgtgcatcagatgtccgtcaatggcaatggctgttgcgggctcctctgccacggcctctggcaccgagatcttgttcaggccaaagagctgggccagatcgacgctagcgcggttggaggggtcggtggaggagcgtttgctgtggggctgagtgtccatcatggcctccatctttgtcttgagctccttgagctgcgaggtctcggctgccaagcgctcctgtgcgtccttgagttccagctcgaggtgtttgcgtgtcaactccagctgatgtctggctctcgcctctgatgcgaccataccgttggcttcctcgaacaaggtgcggctcaattcctcgagctctccttcgaccatctccttggcaagttgaagctccgccaccttctcgatctcatccacatacttgtcgttcaagatggcgagatctcgctgggcactgaggtagtcgtctgtctttgcgtccaacgcatcctcgagatcttccaccttcttgcgcaagacctcggcctcaatggcctcggcggaggcgcgcttctgctcctctgccaggcggaagtttgtctgctcaatgtcctcgagcaagagcgtgcgctcattgtgtgcctccgcaagggaggggatgatgcggtcgcagagtccgcaggcgcgagtggcgaggttggaacacactctgtggcaagggcactctccatcgatcagtactgcctcctcctgatccttggttgctgtcgccgtcgctgctgatgctgttgaatcttcctttgctattgcgtgagatggacccagtgtgaagttcagttagaggctgcgatctcataaagcgcaagttcctctcggtgcgccttccagtgggagcgttgttagggttctattcgtcccgccagtcgtcttttgttgtgtgtgcgtgtgtgtgtgtgtgtgtgcgtgtgtgtgtgtgtgtgtgcacagcgtgattatctctccttttgcgccctcgctctcttttttttctgttattcttgtgtcgccatcgtggcactcggttcctgaccatggattgtcacaagctaatccatcgagaaaactctaacttggcgtccgcccaactccacagatgatgacccgacttgtggcgagaacagattgagagtcctctgcccactcgctctcctttttgtctctgtccgtgcggatgtgcactgggcaacaccaagatggaacaatccacctcctagacacaggacgagacattcagcaccgcccgcggggttgagcgatggcgtcgcctttttttcttctctgtgtcgaccttctcttcacccctgccgagacgatcaactgtaacccacgaaaagaaaacttctccacacacagagtgtgcacaggagagaaggaacatccaccaaggaaccaatcaaaatgcgcctcttgctgaccataagaaaaaggtgttaaacagcgtggaggggggggggtgttggtgtagccagcgtatgtacctgagccgttgacgtctgcttgtccgttcgcggtggggtccgctggcgtcggagcactgagtgcgctggaggccttttgctgtggctccttgacggtctcgatgaggttgtggatgcgcgagtagaggttggcgatatccttggcggtcacgtccttgctcataggctcgggagcggggtgcatgggagcctcagtcatgtttgtgtctgtgggagtgtcagtgagaagcaagggcgggtctgcagtgggaagggcggacaacggaaatcaaaggaggggcgcgggtcgagtgagcagggtggatggagagcagggatgatgggcgagaggaagcgtcgagaaggggcgagcgagaaggatgggatgaaggcagggggacagagaaatgatcttgttccacaggtgggtggaaaagcgttgaacctctgtaactcgtctctcacacgtgacagactgcagcaaatttatgaaggttcttgttgcaatgcttctttcgcgtttaatctcgaggctccaaccgcgtgtttggcctccacacatatgtttcgtctccacaatcctgaacgcgtcgactagagcttgtagaagatcatcctacctacagaaaaaacactaggtcagggtcaacacttgctgcctctcccaagtttcatattctccgtgccgtgattagtcagtcgcccattgcatggcgagatcgatcttttttgttttgacttcactttatccataacggccaattgttatggtgcaacgttggcgccttcttgtcaattgcttcctacttgctgtccatggatgaactcctttgtctgctctagctctctctctctcttacaatcctgactcactccgctccgaagactgggttcccccgtcccgatggtcggcagcctctttagtaaagccctcacgcggtgagtgttggtcacctgtcattctctcctggtagcaaggcagtactttagcctgcgtacacttgcaatgactctctagtcctgctggaccctctttctctctctatgcgtgtgtgttccagttgcgcctcctccctgctccccctgggagaggagtttccctgtacggaaaaacccagtgctgagttcgattcaagcttattcttgcgcagcctagcaaaaaaaatcgtataaaatgaacctgaatcagacacctccacaacaacgcccacgagttgttcaatcaatcttttttttcctctcctctacactttgcttttgtgtgcgtcttttggcgaacttggtcttgctgtcctcttacttcatttgcactagcatccaccctctctctcctcttgactctcttgcttctcagtcttgtgttgctcccctattgctcatttccattgcaagctccattcaacccgcacacctccaagtcctcgcttgcattgcacttcgctcatggcctctcccgcactgcatggctacatcagtcgaatgaagggtcagcggcacgacccttccaaactcagaaccacccagaagccacccacccgtgctgccgtcctcctctcgtcgttcatcgcctccttcatcggcattgccatcgtggcctcgctcacctacaatgcacagtggttcatcgaccgagatgtccccgtcattgccggctcctttggtgcctccgccgtgctgatctacggagccatcgagtcgcccctgtcccagcctcgaaacgtctgtaagttctcgatccctcttgctgcggctaaacacacacatggaatatatctgtctctgtcctcgccagccaaaaaaaaaactaccaggagcggtgctcgagccattcagacctattctaacacaccattctttttttttttgcggcaatttttttttcgtatttttaccctgcgtaaaaaaaaattagtcggtggacatatcatgtcatccctcatcggagtctcgctctacaagctgttcaatctgatgtccgccgagtcgtttgcaagactgcactggctcctctgctcgctctccgtgtccatctcgctcttctgcatgcaactcacccacaccgtccaccctccagcgtccgccacggcgctgattgcagtgacaggtgggccgatcatttacaatctcgggtactggtatgtgcttagcccagtggctctcggtgtcggcctcatgatggtcgttgccatgctggtcaacaatgtcgcgagaaaatacccaagtcactggtggaaccccaagaccagaatggtcaccgtggtcgaccaggatatgtccaccacgctcgccgactttatgccatccaacgacgaggacgaagacgagtcccaagaggaaaacaatagcaacaaggataggaatggagatgcatccgggtcgtccaaaccagaggactcttccagatcttccacgaccgtcaatgacttgatcgaccccaattcgaccctgcacgccggtgcttcgcctctcccacgtggctcacctcaccatcaccatcaagcccaatttgcagtctactatggcggcgagcagcacaaggagctcagggatggcgagaggatgaaggatgaccatggatcgtcgctttcggacaaggatgtggaacggggtcgagagccggagcacgcgaagcgttcttcgatcatcatcgagaagcgcggttcgccccatccttcgcatggaacaactgcctctgagaatgagtaccgtgccacgattgagcgacttcagctccggatccgtgaactcgagaaccagctcgcctccacgagcaagtagggcatcctcttggacaacacctcatacaaacaagcacgacacatgctgacaagcggtgccctttagaattcacactagtagcccaccctccccttccccctaatgttatatatccgcgtcacatcataatacacgccattgtcctttttgaaaagcgaagaaaaagtggatgcacaaaaaacaacaaagatggataatcgacttcttgaaatgcccgcgcggccaatttttctatctattctgtgctggcgccaagggatctctcttctcccattcctaaagcggaaagaccgtcgatcccaacgccatgttacggatcatgccctcgaccacaaactcgtgcacagcgtgatcagcctcttgctgctccatcatagagttgctgttgtcttccaccgccttgtccttgtcctcgcccatgctcttggccattccagcgctatccggtacaggtgacttttgatcctgaatgaccgtctctccctccgttgtcgggtcacgcccatccgttagatcacgctccgtttgcgctcgatattccgctgattgctcctcggcctgtgcttgcgcagcctgcaaagggatcctgtctcgagcagagtacccatcatggcccctgcgaccaccacggccgtggatcccaggcatcatccttgatgccagagctagtggaggctgtcgttgttgctgctgctccgattctccgctcgatggttcctccgttcccagagtaggcttctcctcagttgccaaaggcgctttgctcgatgtgtcattagcctcgtcctcaggcgtgctttccgtcgcgtgatgacctttgctgtcagcatcttcgttggcgagagtcgagctactgagtggtgaatcatgggctgcgtccttggggtataatgaaggagacgagacctgggggtataatgtgggctgctgggtcgctgatgggggtgtcgcgtcggtctctaaagtcggaactggcgcaccagggtttccatgagcggcttgtggttcatgacctggcagttgtgggttctcctgcgcatcaatggggcgtggtgcggactctgggggtccagagggtggtgtatctttagactcttcctctgcagtctgagtgatgctggcgccgctcttctcgtccaacgtagggtcagttgaatccttcgaggagacctgtaattccgcggtgtgttgcgtgtcttctttcgacgactctttctgctcttctaaaacaggagagggctgcctcggaagccggtgcaaatatctgcaaacgaaagaaaaagagctgtcagatgtctgttgtagtaaaagtaaaaaaaaaaacctcaactgtcatgtcacacacaacaacgtacccgtatccgacatcacaacccaaaagaccttcgccgccccactcctcactaggcacaatgaggacctctctgacctggttcctgtcgacgttgtacacatgaagtggtaatgggtccccaatgtaatcctcgatcaggtcataaagatcgccctcgcctcgcatgatcccgagtggtgtcccaatcacataatctgcatgggcgcacagtcctgcctgttccgcaggggatccaggggtgatatcctaacggcgttcaggacaataaaaaaaaaaggaaagcgacagagctgaggatcagtcgtttttctcgacagcccatccattctgaaacatctatggctactccgacgactctttaccaggacatgccaaacaacgtcgatgatggtgtcgaacaacgtgaaccggatgctgcatcccaacagtccatcctcttccatgccgctccagttccgacgaggcaccatctcaattcctagtaaagcaggaataaccaagcaaaaaaaaccatgcggtgtaaatacgttagtcgattgtcaaagcatcttgaaggtctaccaaagctgcaggtcgatctcgtccaatatgtttacttcgaagcgcttgctccctggtcgagtacacatccaggaccataggcttatccacactggcttccattagatcgcgcatcatggtgctttctgtgttctagagagacgcgttgttgccggtttttgatgtgtcagcgagcaaggttcacaaaggaagcagacgtgtgtgaagcccttcataaaaattaaaaaaaagttgcgaaagcccttaccaatcgagtgtcgttgacggccatgatgtagtcaaagtaaggtcgaagtcctgcttgatgcgcaggagagccctccttcacctggtggaaggatgaaaggaagcacgcaaaggattaacacgcctttcaagaagaacaaaaggtctgcgctagccatgctgcaatgtggaggtgtgcctgctggcttcattacccgaagcacatggtaaccgaggcggtacctgccctcgtctcctgatgctgcgtttcccatgcgaggctgctttgttggatggcgatgaacaatgaatttgctgcggcagtttgaacagtggatgatgtaatgctgcagaggttgcactcgttgggtgtgggatgtttactcgagtagaacggaggggtgcaagtgacagagaagcgagagtggcagagagagcagaggagagcgaggcagaagtggaaagggggaaaaggagtcccaacccgtgtgtgcaacccctcgcacactataaccctgggttccacttcacaccaacgtgttgtgctggcgctcaagcactcgtcaactcatacacacatcatggcctccaggcgggtcaaaattgctttttcagtaggatgaagttcattttacttatttttcgcggtatgtgctaatgtacaactaccaatactatacaactgaaggacgaagggaaagcgtttctcgtttagcgcctggcaatggtcgaggaccagttcctggcccgctcgaatccgttctgtccagactggtagtccacaaacgtctcatagatctcctcctgcgagttcatcacaaaaggtccgtgctgcacaatcggctccttcaacggctcgcctgcaatcaccacaaaatgtgcgtcctcgtccttggtcgtgatcttgatcgtctctgcaccatcctccgagaacgtgagcgtgtggtgtgccttgccttggaactccttgtcgccaatgtatgctgtgcctttgagcatatagatgaatccagtaaagctcgaagggatcgtctgcacaactgtcttgttcttgttcatcttgtaatccaagtacatggtcggcgtacgcgtgtacaccttgctcttcacgccgtgggactcgcctgcaatcaccttgacgaccacaccgtcctgaggggtggcgcgggggatttgaccatccagcagttcctggtattgaggctcacacatcttgtgctccttaggaaggttgatccagagctgcagtccatgtgcacgcgtctgtgacttgactggcatctcagagtgtacgattccgcggccagctgtcatccactgcaagtctccgggtccgatggttcccttgtgtcctgcaaagtcctcgtgctggaactgaccctcgagcatgtaggtcacagtctcaaagccgcggtgagggtggtcggggaatccgccgttctggtcgacgttgaactcgtcgagcatgaggaacggggtcgtggttgcgaagctcgggtctgccaatagagcggcggacgcgggcacccacaccctcggactgttctctagagagaacggacttgacgatggatctggaagcggtcatagctgtaagagttgttatggtagtgaggtgtgttggttgagtttgagtgtggagtagagagtgaatgttcagagtgaggaaagtagtatcgcgagatgcactgtgtttgctgtattgcttttggaagtgaagagaaacgttgtgagggtcgcggacctcggtctttatagttttttctcggccgcactttgcttcgaaatgcttatgcagcagcagcaaatgattggacgatttgagggatcgggctgagaccaagccactttgtggctcatgcacgccttgactcccttgaaaagaaagttgaaagctcgctgacaatgcagaacgaggagaatgtgccacaaaccgccagctcgcacaacgttttcgtgttcaagcttactccagcaagaaggttctcgcatgaaggtgcttactgctgcagatgatgttgtgcacactggatcagcacaaggcagggtgaagggacgattatctacaagtgcgatcagtgaaatcatgaacaagagctccgtagcactgctagcccatacacacatcgcagcctaggctacctgctactcgaatcctcatcgatgtctgtgttaagaggaagtgatgatgaataagagggaagggacggtgcaacggtatgtagaaactacacgttaatattacccaactcgcgggattcgtgtggccagtacgagtcggcgaggaaatactctgttcaaggaatagtcctgacacattccatgtacctcagagtgcttcgtagaactaagatgttcctactttctgaccatatctgcctctgcttccatgtcaaagtgagtctccacggcaattatacgctagccagactttttctctcagtcttcaagcacgaatcccataaagacacgagtatttctttcttctggaggatatcaactctcatccattgggagatgcccaaacaaatctcactacctttcccatccctgtcatatttgaacttggcttcttttcaaatcttatcaaccatgcaagccatcacgcccctgatactgttgatgctgcagcttcctcctcctcttccttctcctcgcgcgtcctcgcactcgtctccaaagtgatactccaggtcctgaacgacctgccgtagtattccaccgctcgttcgtcgcctgcaatgaaatctggttgcgcaaccttggaccgcatcaacaaccgactgccttgatcaagcatgtttggaatgcagtccctgacccctgttccaaaacgcgtcgaattcgtcctctgtcaatgctcctgtcttcgatggccttaccatagccgaaaatccgtgagctctccaagtgttcacagcactgctgcaaatgtcctttttgggtgtgggatgtctacatccgctgaacagatggtgggtgcaagtgacagagaggcgaaagtggaaatgcagagtgatagaaaagggggaaaagaagtcccaacccgtgtgcaacccctcgcacactaagaccctgggttccacttcacaccaacgtgttgtgctggcgctcaagcactcgtcaactcatacacacatcatggcctccaggcgggtcaaactgctttttcagtaggatggagtccattttacttattattttatcatggtatgagctaatgtacaactaccaatactatacaactgaaggacgaagggaaagcgtttctcgtttagcgcctggcaatggtcgaggaccagttccgggcccgctcgaatccgttctgtccagactggtagtccacaaacgtctcatagatctcctcctgcgagttcatcacaaaaggtccgtgctgcacaatcggctccttcaacggctcgcctgcaatcaccacaaagtgtgcgtcctcgtccttggtcgtgatcttgatcgtctccgcaccatcctccgagaacgtgagcgtgtggtgtgccttgccttggaactccttgtcgccaatgtatgctgtgcccttgagcatgtagatgaatccagtaaagctcgaagggatcgtctgtacaactgtcttgttcttgttcatcttgtagtccaagtacatggtcggcgtacgcgtgtagaccttgctcttcacgccgtgagactcgcctgcaatcaccttgacgaccacaccgtcctgaggggtggcgcgggggatttgaccatccagcagttcctggtattgaggctcacacatcttgtgctccttaggaaggttgatccagagctgcagtccatgtgcacgcgtctgcgacttgactggcatctcagagtgtacgattccgcggccagctgtcatccactgcaagtctccgggtccgatggttcccttgtgtcctgcaaagtcctcgtgctggaactgaccctcaagcatgtaggtcacagtctcaaagccgcggtgagggtggtcggggaatccgccgttctggtcgacgttgaactcgtcgagcatgaggaaggggtcgtggttgcgaagctcgggtctgccaatagagcggcggacgcgggcacccacaccctcggactgttctctggagagaacggacttgacgatggatctggaagcggtcatagttgtaagagctgttgtggtggtgaggtgtgttggttgagtttgagtgtgaagtagagagtgaatgttcagaatgaggaaagtagtatcgctagatgcactgtgtttgctgtgttgcttttggaagtgaagagaaaagcagtaagggtcgcggacctcggcttttatagttttttctcggccgcactttgcttcgaaatgcttatgcagcagcagcaaatgattggacgatttgagggatcgggctgagaccaagccacattgtggctcatgcacgccttgcttcccctgaaaagaaagttgaaacctcgctgacaatttgcaaaagcgagaatgtgccacaaaccgccagcaagaaactatgctatcctcgtatctaaggaggaaaggagacgtaactcgacaacaagtattccaaaaacacaggcttcaagcttatggcatgatatgcgcgtgcactgcattgcgtttttatagtcattgacgcgtagatgaatgaacaataaagaccaagtgcactcgagctcacgctcaaaaaggaccctcctcacgcgtcttcgtactcggctccaaagtgataccccagctggttggcgacttgctccttggtaccccaccgctcttcgcctgcaatgaagtctggtcgcacaaccttggaccgcatcaacaaccgatcgccctggtcaagtctgaaatacaatccctcgactctgtcccgtaacgcttcgtcgtcttctgtcgaggctttagctttcgttggcctcatcagtgccgagcgtccatgaaggcactttagggtccaccgcaaggtcttctcgacatcaccttgcacgtcctgtggaaccgtgaggaccgggttcgggaccaactgagtctgcgcaattgcgtttcgaaataccgcccgagagacaaaggtgccagtcttgacatcgaggagatcaaagggcacaaaccaggatcgcaggccggtgtacttgaccgagtgtttggcgtatagccattcgccgtaaagtacatacggtgccataccgtcctgcaagacctcatcctcatccacgtattcgttcacatcatcttcatcactctcctcatcctcccagccgtgatcgtcattgccaggcaccaagggcgatcccgtcttgtcatccgatgtttcttcgtccacctcctctgcatcctgatttacgccagaaacaccacaccccttctcacgcgtctcgtaccgccatcggccctcacagagccagagcacgtcctcccgatgcttctcaagccatccgatcagcttcttgaactgccaatggtcgtccgggtgcacaaagtggttcctgttctggactctgatctttggaggcggaccgggcacggatgagactcccgcaaaaccatccatcgtcctgaaatgtaggacactgaacccaatgttggccccgtccatcttttcctcaacggtcaacacctggtgcggctttggagcaaagacctgtcggatagccgacgggggcaagagcagatctgagcggctgatagccgagctgcgtcccttgttggaggatgacttgcccgtgctcgaggtctcaacgcctttttcaaccatgcgatccgagtttcgctcccagctttctaggatcgtgagagggtcgaatagatgtggagtcctagggaacttttgcagcggacgatcgaacgtggagaggggtgttgcgaatgatacgcccttaggcgaggtcggcactgtgttatcatcggtcaaggagtgagtgtcgactgtgctgcacttcctgcctccttttgctggccgtttgacggcgggtcgatatcccgtaggagaggcaaactgaagagccttgctgatagacaagctggaaaagtgcggcgctgaggggaaagcagcacttgaagattcgcaatgattcttgccgtttgtcgctgcctttgtctcctgttcagcatgatcatcatcatcgtgcgactgatcgtcctcgtctatgtcttcctcgctctcgctcctgctgtcttcctcctcgctctcgtcactttcgtcttcgtcgtcatcctcttcctcaccctcttcaacgctcgccatatttccagtggacaaagttttggacgacaatgatggcgctccggatgcagttaccgcatcctcatcagctgaggcgctgccgctctgtttccgctgcaagactcgggctggaataaaagctggccgcgccttgatgggcgtggattctactcctcctcttcccgtactcctgctgctacttgaccctggaatgtcccgtgcaaactttctcatcacctccagcagccgatcacatccatcgtcgtcgcccacttcaaccagtgttttgcaccaacttccttccttgctcaagttgggagcctcgaagctcttggcaaaactcctcacgactttcgagcccataccctgtcccaccgtagggtggttctctcgcgagtcaactcgctcaatgcagtgatcgaggtccctggagaaccaaaccatcgctgtctcgtccggctgaaaagcgacctcataccactcctttcgttcagccatagtggggttacatctgtcgataacgatcgtcatggggagagccttgttgggtccacgagccacgagcgactgctgctggtgcctcatgctctgcgctaacagtctctcacaaacagcccgggaacctaattcatcctgcgaaatgcggacaaaatgatcggggaattcgtccagcagagtcgtggctaggtggctctttccgctgcctggcaatccagcaaggatgataagcttgggtgctgaggtgagtggggctccagagacgttgtatgacggtcgctccttggactgcttgccaccgcccccattcttctttttggacttttgaccgcgctgaagctgccgagcgcgaatattgtgctggacaacgaggtggtgttggtgatgcgatcctgggattttgatgatcttgtccgctggtggaggcacaaacactcgcggctgttcctgaggcagctttcgcgaattcttcttgcccttcttgccagacttgcgaccgtgtccagactcgtcgtccgagaaatcgtctccttcctcatctgctgtggccgcaggtaacgtctgagactttgatatagccgccttctttttttccttctttggctttggacgatccaggttacctgacgatgatactccagttgactgggcctgagcatcctttgcctggtcagctgaggccgaggagtcttggacggcgattgtggctcgcgatcttttagatcctggtgatgacattttccatagccaatctccatatgccttgacagccttttcctgctcaacactctcgatgcttcccggtcgaatttcccgaagatgtgccatggcgtctttggcagacatcatgggtcgatagcggttcaaacacttgcggggactcacgacatgaaaacatccgccatccgcgctgaactcgatctgatccggttcttcgccttcatcgtcattggtatcgtcctcgtccgctgcagagctgcagatctctggtaaagttgtggccgtggttttcctgtctcccaagcccttgcggaactgctccagatcaaagtgatgtacattccctttctctagacaatcagcgcaatatcctcgattatcgtgccccgcgagtccatatcgtatcagatacgctgcgagcacaatgccggccctgccctttcctccaccgcagtggatcaaggtggctcgttggtgctgccacgtcgattcatctttgttgtctgtgctggaagctccagctctgaggcaccagcccatcagaacctcaaagacctccggatactcgggcgcctttctgttttcgataggcacaaacgcattcctgattatgccctgtgtctttttactgtccgaggggataaaccatgtcggcgagagcgggatctctcgtataagcgtgatcaccagcttgaatccactttgcgccaatgcatcaatgtccaattcgtttcttgggattgagcatccagcaactgtgcaagagtgtgggttcaagaatgaaaagaatcgaggaaggttgtgtggcgctggcttttgtgtgatggtggtttgccatatggtggtcgcttcgttgcccaggatcgttgcttgccgaggccgaagctgctggtccagctgagagtctgcttggctgattttggaggccgtggcaaggacaatggccaataactgctggtagagctccttttgtgctgaggtcaaagcgccatagtaccgttgagggggtcccaaagtcgtgagcgtgtcccgacccgagggcaagagatcgatccggacattgatatggcgcgacagataacacagtgccgtcaaggtatacgtctggataggggtgatggtgctggcatcgatgtgtggtgtattcgggggaacttgtgctggaaagactagctcaaatggctcctcggcctggacgtcgaggccgagttcctcttctagatccagtcctttggtcagatcagtccctgggctggctgcggcgagcggatccagtactgcgtaccagaagaggacgctggcctcgaaaaaatccgcatccctaaaggctgctgcggctcttgcgagcgtgagatctatgggcgggcgatcctggtcacaactctccatgttcgtgtatgatgcgacggtggtggtcgaggggaaagagagtgtgtgcgagtggtatctggtgtatccgtgtggttctcgctccctagttgtgaaccaagagtacagtaagaaaacgaagacgcgacatgagtctgtggccaagcacagtcgtcaatctgtctgtccgttgcagtgcctgtgggcgtatcacgtacggatggatctctgtggtgtcgcgagatgcagctcgctcgagcgaagacagagcgggcgaagaggagctagaggagggagtggggagtggggagtggggagtggggaggaaggacggatggatgagccgagggtgaaggaatgaaccaatgaaaaagcggatttgcaatcagcagcacgaatgagcgagtcaaagaggagcaactttcactgcaaaagcaaaaagcggattggtggcaagaggcctctgtgcctacttacatagttcatacgtgattctggcatacaagggcatgcgcgagccatggcaccctccccgcaacgcagcctggtctggccaccccttgtgctggctgccttgcctggcacccgcgtccccccatcccgcacacgtgctgcagtgcgcgtaccacccgcacgtcagcagccggctcccctccagcgccatagagcttgctgcagcgacaggacaagaaggcaagagggccactaggctgtcacccaggcacacacccaaaaaaagacgctgatgagaccatcgcgctccttcgctgtcgcttttgtctcttcctgcccacaccacacacacgcacacacacagacacatccgcattcacactcccgtgcacactcgctcccacactcgcactcgaccgcataaacagccagcccgcatcaatgtcgctgtcggccttccccatcggcctggggctcaccaccgcagcccatgtccatctctgccagcgtaacatcgccagggctgaaaagcatcgcagtcggtacctgctccagcacaacatagcgcagctcgagatgctctctcagtccctcgaggacctcaacgccctcacagacatgatcgataacatcaacaccgtactcgaccggttctcgggtccgcgcacccacaagcggcgacccagaagacccagacatcctggacagccccagaacacgaccactgacgcacatgatcccgctcaatgcagccttggcaatacaagttatgaggcatcaccagaatccaccgccgatcctataagcaaggatagcagtaagcgcttcagcgatgtccttggatccagagagtcaggcccctacgacgacggcgacgatatagttccagcgacccatgctgacggaccagcagcgtctgagcaccgcgccgggagctcctcagggccaaggacacgccgtcatcgctgcgcaggctcgtccgcgcgtatagttgatattcctgtgggtagggacaagactcagtcatcattcatacaacgacgatgttgtccgtgttgcaaacaaacgcgaccgaaaacgcatgatgactaacgtggtgcacactcgggttggttgctttatgtatagaggaacttgaagagtggacaaaggtgtacaagacacttcgggtcagtcaggagcaatgcaacgggagaacctttgaacaaatgcgtcggaccatgccctccacgttcctgttaaagaacgaactggtgttttcgtttctgtaagtcgaaattcatttctgcttcacgtttatgaactgcttatgttcgacggatcgttaatatccgtctgcatttgatatccactctcttcagattgagcagtgcaaccatgctacggttcctgtgctccacgaaaggattcttggcattctttgcaaagcacacaactcgccttcgcagccttgtgtcttggatcccatggccttggtcaccgccctcgacgtcctacatcccatggggactcgcaccgaatagtagtcagtcaacgggccaaaacatggatgcactgatatcaggaacagcaaatgacccagctgcagcacgaacatcaggtgtatcagtggcgtttgcctttcttccactggtgccgactctgtttgtgtctggtatccattttctagcagcggcaagaagtcactggactttgcgcaacatgcaaaaggatatggatcggaaaaagcagttcatcaaacgactcgaagtgctgtctctgtttctgttgattcgggaactgcgcctaaagtggctggtcgaggaaatcgaggcgtatgatgcagacgaggccttgagggaacagagcgaggacaatgacgaagacgcctttgtgaatagtgccagcgcagacccatcatcagcaacgcgcacaggatcagtggacccacccacgttactggcaccaggcttgaacaaccgcgtttattctctactccaggaccgtcaaggcgatctcggatcacggcctcggaacagcaatgacaggcgccggcagcagccacccccaagatctgggcaacagggttcgcgctcaaggacacgcgcatcaagcgacctgaaattctccacctttgggccagatctcgagaacatggacatggacctgttccttcgcgacgctcgagagagatccaggatcctccgactcgagtttgagggcatgcaccaggagctgaccttgtttcgaggactgctgctaccactgcgctctcgctcaacctaaggaaatggaacatgctttgcgccagattccaaatggctagtcaaaatacagttgtttcttgcatgtgcagccatcgactttcgactatacattcatggcgtacttttgttctatgtgcagtgttcctttttcttgatctttctgttccagatgacacccgatcaatcaatccgtcgagtgcacggcaatcgcatgcggcatgccccagcatttgtatcccaagaactttgcaacatagcacagaccctccgtctcgatgccatcatacccctcatgatgccagccagtgccaatcacatagtgggtcgtaaaggccaccccttcccggtgcacctccgctcggacaaacaggaccataccccccacagaatccagctcaccaaactcttggctcaactcatgcgtgaactggacgctcgacggtccaggcacaaacactccacccgcctccaccaccttcatctgttcctcgttgggctggatccgttcgcccacccaagcgttcaaatccagaaagtctcctccgggaccatatgtcgcagcggtggtgatgatatccttgcccgagtgaaccatgcggcccaagacatcggacggaatctgtgtcacgtccgcatctatccacagaaccgcctcctcgtcctgcaacgtgctatacagaaggtagttccgcaacctcgcaatcaatctccgtcgctctcgttggacatcgtcctgcttgcgatcctcgcgtgcgatccccgcaccctttcctcgtaaaaggatccggacttttggaaagatgggttctggccactgacggacgatcttggagagggcgtcgtattcgtgtgggtcgctgaccaggacccccaggtggaggtgggagggtgggtagtcgagggactggacgagccggataaagtccagaaagcttcggttcgtgccccaaccctcatggttcctcacgagggtgaggattaacactgtgggcttgtgcttatcccggaagcttgttgccgggggcgatgagaagtcaaagcgggtgtcctttcggtggaaaggcatttcaaagtcggatagctgcgatacccacaaaaagatgtagatcaccatggctgagagtaacagataccgcagttggatgccgcatggcgacctctttatcattggaagaaacataaatccccacgcagtgataagagtgactctgagctgcaagaaatgagaggaagttggaaaaaaaaaagagtcgatgttgaatagcaggagtgcaaggaaagagatattttgggagggccaggattgaagttgcaaacgatgttgtagagacgagcacgaaagagtggaaagggcgcgtagcacccattgtggtcctcggcgggcattgcgccttcggtatgatgaaaaattgtgggctggcaaaccaaataaaaaaaaaaaaaattctagcgatctagtacgattggcgcacaaacggtggtgaaaccatcacgatctgtggtgctgagaacttttaaatgggctcagaatacagcccagattttcgagatgaaaattcacagaccatcgtacgtaccccaatacaagtaaggaaccaatggagacaaaaaaattatctgtctggcgagggttattgcacgtacgcacacgcggtgaagtttcgcgcgttatgcaccctatcacgcacgagaccacaatttgaaaataaaaaggaccagactggcaaggggccggtgcagtggtcaaaagatgagactattttaaaagctctgccgcttcgttctctgcctgcgctctgcatatttcccgcctcatcctcctccaccgtttagtactatgtacaacacttgtagatgtttaacatgccaaattgagcatgggggcgacggtcctgaagctgcagccgcaccatgttctttggttctccaattacgtggaggcgcggtgggagtcgacaagcagcgaatgaaaagaagattccgacgtgtttccagtggacagtcccatagctctcaatgccagtccctgaacgccctcgcccatctcacccctcccccctcctcgctttgtgcccaatggatgctatgcagaatgggagcactctgcgaggcagtatttcaatttcttcagtcaatttcagtgcgcccactgtttattgctctcagcccacgacgtgctttcctgagtttcctccactcctaatcttctcccacacttgattttagacgcgcgcaaaagtgcagatactaaaatagtgggcgtggctgggtatcgaaaagcgtacgggaacgcctggcgcgggggtcctaaaaaaaaaggccgtcctttgaacaacgcccccaattctctgcagtgactgcaataactgcagcgcagagcgcatcgagcactactgattccgctccgcattttggcagataatcacctcgatgctgatttttttgtgaccatcgcatcgacagagttggttgtagtatgcccgactatatttgtgtgtataatatcgcatgaaagaatgaaagaaaagtggaaaagaaaaaaaaaagaaaagttaggcatgcgacgagtacaaggggaaacagccgcgcatggtacacaaaaataacccattttggaaaatgaagtgggcgtaatggttcacattccgttggctgctgcgattattggattgcgaattgctgggaccatgaatgcgtttctcggaaaacaaatgggtgtttgttcgtaccagtgccaagataggttcaaccttaacactcaacgggcgacacgggaaatggcagaccgtgccatgcacgaacggccaaactagaaaatgaagacacccatatcaatccgtcgtccagtgctgtgtctcaaagaactccctcgccccttattcaatccctcgccttcagtcccgcagagcaccagagtccgaagaaaaaaaaaatgtcgcagtccatgccagtccacgaaaccgtcaacgctcggtcaggggccttgccttagctcttcggtcttcgatcgcgttcttataaagcctgcggtttcagcgaaacaatttccgcttcttccttatccaattctcaccacttcttttcagaaacccacctaccaactcacctatccaccccactccaccatcatgaagttcaccaccgtcatcatcgctgccctcgccgtcgctgccaccgcctctgcccaggctgctgcccccgcctcggcctctgcctcctcggcctctgcctcggcctcctccgttgctgcctctcacacagcctctgctagcgctggtgtcaagcccactggtgctaccggcggtacctctccctccagcagcgcccccgttgccaccggcagcggcacccccaagtctgctgccggaaccaacgccgttaactcggttgtcgccgttgccggtctcggtctcgccttggccttgggtctttaaatcctttgcccaccgccatggatttcttgatgagaagcttcgaattctagagcagagcgatttctactacgcgcttgtcttttgtggccatgctatttgaatagaaacataatttatatgcagttagaggccttgctcccaactttttaagcattccgaactaactagaccgaagcagctatcccaaccttttactattttcctacttcctttccataatctttaattcctttttttttcttgcaaagaaaaagggctaacctaatactgtttatctcctgaagttccttttctttttgttcgctcgagcggaagaaagaacgacgtgaataatcatattgtaataaagaaaaggaaatctaatctaaaacagctctgcctgtccacaacaactcgacgatcataacaggaattcttgggatcatcatctgaaaagaaaaaggaaaaaaaaaaaaaaatcgcaaaatatatttaaacatgaacgaaaaaaataaagtggatgacgcgtctgcagctcgactttgatgcctcaagatctaaatttcacgacgcccaatgcgccgcaaagacagtttgccagttttacaagaaacgggtggaggaatcgaacggtaaattgtgctagtttttttttttttttttttttttttttgtgctaaaaaggaagcagatggcagtactttccctccatcatatgccactatccaaccgccaagtacacctgaaaatatcattatttttttcaggcgaagcacgcgtttgctaaacatcccttacccgttgtgcatgagacatagtgctgcacttactttttacactatcgcgtaccagcgcacagataccgatgtccgaccgacagcgttacaatgcagtaggcacaagagcaacgagaaagtaaatgggaaaaaaaagcgttgaagacgaaagagcctgcagtcgacaagaaaacggcgccacccacaatcatttttctccagactttcctcattcagtcatcggtaaccgctcccgagaactctcatgcatagaacatatattcattggcgggatacacatgcatgattcatttgtcacgagagtacaggcatgctgagaaaaaacgaagaaaagcgcacaaagcagattgactggggtagttaacaaacggtcgtaactgaatagagtcgaaatacagacgtgaagaatagaagtatacaatatatacagactttggcctcgtatgagcgcgcctttctttcatttttttttgtcttaatctaccagaaggcacagtatccgacccaacactgacaaagattctcggttgaggtcgcctgctgaattagcttctccacctgcagtgcaacatccagcgtctgatctgggtggaaatccctgcctgtgagtttgttggtaacgcggttcagaatcgtcaaggtacgctgattcagctgttcgggctggttctccactagattttcaaagaagaataatctgtcagattcattcacagttcgaactacagaccactgtggcatgtccatgttttacagagaaaggtgcatactctcagcctggtcaatgacgagctcctgctcgctgggcaggggtctccgcaaactgcgaccttggtctttggaaaaggactcgtgtgctgcagcgacattgccattctgtccctcggtagtggtcggcactattaatagagatcagaatgtgttagatgggggcaaaatgcggaatagaccttggaaggtacagaacatgacccgttccctccatgcagtggaggtcaaagtggatcttcttcctcccgccctccctctttgcggtccgccttgtcgaacttacattgtctggggctggtgtgcagaatcctccagttgataagtgggtcgtgaacaaaggcctcgagtacggccatgacgctctccttgttctccctcaaaacgcgcatcacattttcacatgtgttcctgaagcttccttcgataccgctgacctccatggccttgaccaacatccttgtcaaccggaatggaattctctccgggaattgcggtcgatgcattgcaacctaatgatggcaatcgatagtgagccagagacatgaagaggacgtacttagcaggtttgcttctaatgcattaaatcggcttcaaacaacacgacaagagttgagcagacccacttacctcaaagcaatcgccgaaatcgatatggacaatacgaccggtattccgatccatcatgatgttcgatggatgtcgatctccaagtcccagcacatgtcccgccatcgacataaccgccaagctcctggtatagttcgtccgtcgctcaaaccacacctcagagttccgactcttgagccacaagatattatacagatcaaaggcttcctcaggtgtgttggccagcatgttctcaaagatctcaatcttctgcatcaccgtcagcgagtcataactctgctcgggcgccatgctcgtcagaaggttgtgctccgtgaaaaacgaccgcctcttgctctcacgataatctcgaatcagattgtgcagggtgtccgtctctggaagccagccaatgaggccagcgttgggtgacagtgggataaccgcaaattgaataatgctcaggtggcgcttgaaggtctcaggatcggcactgaggagtgtgttgacgaggccaaacagttgcatgacacgttcatcttgcctcaggtcctcatgtcccttgagcaagaactcatagtcccgaccatcactgcccttcatggtcagtcggcgcggcttttgcttggagctgagcaccgtcaacgtaggcttgaaagaggagatcttgatgataggtgctccactcctgtaagttcctggaatcgccaactccaagtcctgcgcgttctggagctgaggtgaagcgtacggtagttccagagtgctgagttttggcagcttgcgaatccggttaaacacctggaagtagatatcccaggcatggttcagctcgttcacatcccgcgtctgacggaaccgtgtgcagcagtcaaaagcttccttcaggtcgcgaccaaacgctttgacaaacgtcacctcatgctgggtctcgggtcgcttcatgatcatcttgtggagtggctccaacacggccagcatggcctcgatgttcttgccaccttgggcattcagcgtcgaagcctcctccagtccttccgaccacatctcatgccacaaaatagcgactcgaagcagttcttgactgaccattgaagcttggtccacgagaacggaactgtgcatgcgcatgttgtccatgatcgccaacgctgctttcctgcggaatacactgggggactttgaggcgacggttagcgagtagaccagggcttgcggatgggctttaccgacatctgccagcaattggtgaattagacgatgaacgttctggctgggcgcgtggatgcgagcgatcagttgtgggatcacttgaagccacgtatcgatgctgaccgtcagaagccccttcgccagggctgcgctgacgtccggccgatgtccgaacttgaaccaaagcgtcaagagtcggagagtgtcttgcagcgagttaccggcggatagtgcgatggagcggaagaaacctgtgaccgacgggataacatactgcatgctctgagtagcgcctgcagaaccatctttttccaaaaatgaaataacatcaaagttcgccagtgcccaggtgtgccacgccttgtaccagctcttgtccagatgggttgcatagtggtgaggcgtcagaatgtactcaatcgagtcctggtcacgtaaagcacaggatgacaagcacagaagccgttagatggaaacaaaaaatctgtagctagtgggcattggctagcatttgcaacttacgtgtgtccagccgtcttgcacggcaaactgccactctccctgtttgaggtagcagcgcgccagtagtcgggagaagtcttcatccgttcctttcgcttggtgcacaccggtccttgcagccccgttcgtgtccccggtgccgagtcccaggtccgctgccaacagatccgtgaactgtcgaagacatccaagggtttgttcccgtacacctcttgcccacatgtactttagtttcgcgtaaacaacctgaggcggagtgatctggatcatctggttgaagggcatctcagcagtctgctgccccatcaacgagaccatagcctgctcggccagtcgcaaccgtcctgacttgcggcaaaggttcataaacttgattctcatgtccatgtcctctgccggtgtaagcgccatcgcatgaactttgatgaccctctgccagatctcgatattgcgttcacatcctagtagacgcttcatccaggttttgcgaatcgtagcctggcgatctggctggttttcataccgcttgtacgtgatgatctcctcgagctccgccatcatctgcactcgaaccacagtgttgtaggccctactgtaactctcgctcacaagcgccgtcaactctgtgtccagcaacgtccgggtgtgctcaatgtactcctctgccttgtcaaactggttgcgatgaagcgaaagaatggacttgaagaaggcccggtcgggagactctgtttgcatggctgagatgtactcgtccagcagctcccattgccccaatccccaggctccagcggcgacaaagggcgccatgcctctgcgatatccttctggggcaatagcccacttttcctgagccagagacgacagggcatcccactctcctagggcatgtaaacagcgcatacgcttgacggccaagagaaggtcgtccgggctctcaagttgcttccgttcatacgcagctaatgcatcttcccaccggtgaagtttctcgtaccaagactccttaagctcgatgtcatggtgtttctgtgcatacgttagaataccggccgcagcgtcgggttgctggaggttgttgttgacgctgatgaggctctcaatgttggctgtcgaatggtccgtcataaactctgcttccttgtaatgcaaagccttcgcatatgcgtggcaactgagggcatacttccccaaggtgctgatctcgatcggaagcggcttgttgtcgtgctccatgtactcggccatgtttagaagggtttgaatgttttcgggggagatgtttggcgccgtcaaggctgtcttaatggcagccgcaaactcttcctgtcaagacaaatgcattcaagtatacgaaacacgatcagtacatgcctctgcaatgctttgaatacatatcaacgtcgagtttggtgttaaccgtcaacgcacctgaaactgctctgtcaaggaagtccagcatgacatgaaagctgagttgaagagttccctggcaagcggctggaaagaattggccatgtctgcgcaagccctaagcgaatgcgatggtgtctctttcaacatttccagcgtgaggcgccggatccagtcagtccagtcctcctttctagagcgtgattctgtatcccatgctcgtcgcagcgaccgcgggttcacgggtagtttgcggtcgtcggacagggcctggggaacatccgtggtaaccacatatctgtcatctcccattccagtaagcactgatgccgaaggaagaggctccttgttcagcagcttggcgaccaccagattgtagttgctgtgaatgatgcgctcccgaatcagcacctaattttgataacaggagccattggcgtcagcagtgtgcgcatgtttatggttcaatcagacaggaagtgtcgcctcacttactttctggacaagaggaacaaagttcaagtagtcctggccaagttgtacgaccatgagacagagcacatccatcgtgacggtcctaagctctgttccaggcagagccagagttctagcaagtggatggataattctggacgcatagtccgaaaagtcgatccgtcttgacaaggctccgatggtgctgatagctgcccgacgaaggttgatgggagcatctgttctttcaaatgccttgacgagtactggaataatcagatgcatatactcctcaacgttcgaaccaagcttgacaagagcctgcagaacacgaagggatgctccatggcgctctgaaacatccgtctccaagacctccagcatggatcgaagaagttttggcatgtacgccttaaactccccatccagtgagatcgctatgctctcgatcagtccaacgattcgctcctgcagtcgcgtgtggctccagttgtcctggatgagtttgaccaggtcgggtatatagggtcgaatatggagctttacgatcaagaccagaaagcccatcttttcaaagtagaaatccaggttgtgcagggtcccggactgcatgatattcaggtatactggcatgatctaaggagtttcaactgattgtcagtatgccacgtcgacagcggagataggaatgatggacagctacgtgtaaaggagattgataactaaaagggctacctggggtaaaaatgggaccatcttgagttgaagggcctggaaaatgttgagaatcgcctgggtcgctggttggtattgctggctaagcgaaggatctttgaggatcttgagaagcgcattgatcaccacggtagggtaatattcatcagaagatggatcgatgccggacattaagagtgccacatccgagttctccgtcttctcggattgtttggagtcgcctgactcgacaaccatttgctagatgaaggggcttggcatgagtacagatcgtggagagatgcagcagacaatgatggaacagaaataacgaaggtgctaccttgtgtttgtagggatccaatgctccgagtactcctacaagtttcattgtatcctggcggattttgaccgactgttcggttttcaaaatggacatgaggatatccaagaggatcgggaacttcacatacgggtcgatgacatatcccgtgctgctggcgagacgacctagggccttcagcgcagcactccgcttggcagatgagctctggtcctgaagaatgtcgatgaacattggcataagctgatccgtatacggcagtaactcctcgccgccaacccgagcaatttcgcccaatgcttggaggacgctggacacgactccggggctggtgtccttgatattgggcagtagcaccgtgaggatggtctcgatatacggccggacaagttgttctgatgccatgatcaaaagggtcagcaatctcgcgctttcctctttgtttcgccccaatcccgagtattcaatctctgagagcagctggatcaaaatcttgcggagcgaggggtgcacatatgcagggttataggctgcgatgcgtccaatgatcgtgatagccaactcgcggatcacaaacacctcgtcatttagcgcaatgaaaagcgatcgcacattttctgccctggcaaggtgtccatcaaactgactgtccagtgaagataggacggtctgccgaatgactggatctggatccgcgatcccaacaagcaaaagcttttccaagacttcatccaccacttggacagcatggacacttgtctggtgaacaatagggtcacgagcaaacagctgacaacaagtctgcgctgcggagcgccgaattccggcatggtcgtcgtccaaatatacgatgcaggagtcgcgcacaaactcgttcagcatgtgtcctgaaaagttgaaggatcccagagtcctcagtgctaggatcgtggcatccacctgtcgagtttcggcaaagtaggtactgctgcgggtgggcgaacccttcctaggctgaggtgctccgggtgctctgtacaattgcccactcaacataacagagatcatatcgagcagtcgatctataagcgttggatttatgttagtcataatgaataaacaaatcgagcacaccgggggttttttttgaaagtgaggtaccataccttgaattccaggcaaagaatgagggacatatgttgccaggtccgttaatgtggagcagagagcctcgctgagtcccgtggccagcatcaagtccaggagttccactaagtgaaatcctaaagctgggcccacagcatgcgcaagcatgctgatacagccgaaaattggcgcgtccgtcaccgtgcgatttttgctagagtatcgttattgtatcagagttttagcttagattctcaatgtaaaggctgattgagaacagctagatcacagcattcactgtccctaccttttcgcccgcagactgtccttgatacatcgcatggtgtcatccaaataaaccgccatatcctgcttggctactattgccagtttaccgatggcgaggaacgcaatcgatctatccatctcgttaactggtttccgctccttatccatttgaacctggccgataagatgcgtcatggactggtccaagtaatagttgatgaaatctgggggatcgtatgcggcaagaatcgggatgagattgatcaccgtgcgtctgatcaagccttctcggtggttcctaaggcgcaacactgtttcgcacgtttccgcgaaccgagggtacatgaacttttgacgaggcaggaagttgaggtgagtatagacattgattgaatcgagaacgacgtgagcatggtgctatagagaacataccatattggcctggagaataagttctcgaatgattaacagagatccatgtatactctcggttgttgctatccggagccctcgctgcgcctcctcgttgatccgagtatgccatacgttcttcagcggggtctctcgatccgcgattaaaaccagaagagcactaagggtatcagcggctgcgtctctgatagcttgctatgaatgaggcgatggttttagtgttggatgctgtgaaggcccatgcttgacaatccccgtatgctgtataccctggatgacccacctttggttctcgtatggctccccaaatgtgattcagaatcgtgcccacatatggatatacgatgacgctggcgtgtcgcgcgagttgagctagcactaaaacgctagcgtgcctccttgactcctggcgatctcctgcatgattcaaaagaaggtaggtaatcaatctctctgctgcctcaatgaccgacgctattactgcagcacatccacacagacggtcttatgctgctcctcacctgctagccactcaatggccctcttcaattcgaattccacaaagtctgcggtatatgttccgccttgttgcgccagttttcctagagacgagtcgcgtagaaacccttcaggttagtgcgatgagccgaggcaaccgcaattatgccgcatgcccacttgcagccagtgcttaccaagtgcccttgctgccacagtcataatcggcacatcggatgggaaaagctggcgcaggtagttggcgtatcgcgtttcctgcgcagtgttgtcttcgtcctcgattccgatcaggcaatctatcgtcaggggggggggggggggggaaaggaaaatgtgagtaattcagttatcacacagtggacactgacaagatgtgatgggcgagatgcgggtcggggcacgcgatctattgctaggaaaaacgtctaccaatacaagatggcttaccgatgatgtgaacgccgcacagcttgtcgtcgttgtcgacactctggacaagggcacgaagaatgctgttgatctcgccataaaatttcgtcagatcttgcccagagagctctcgagtcgtaagtgagacctggcaggggcgacggaaagacgaggagcagagggaagagtgagaaaagatatggttaatttggttcgacaggacaagtggaatgtatcgaactgatcacaaggcgcccatgggtcagtcgggtttggccggtaacatgcatcctccggtccctggcgtagcattctcggatcaggggtggatccactttctgacgcacggatacgcagggctggttgatgcgatggagggccagtgctcaagtgggaaaggctacctcagtacaagcccagctcggcatgaagacttacgtattcgctgagggcttgcgtgcaagcatccctggccttgtcattgtggaggctgtgtttcgagaaacaggcaaacgggtctgagttagcacggatcgtcgcttgctggccattcgattctgtcgggtctgtttagctgctttcgacatgctacctggctttgagatcactggtcagtcgcgtgaggttcaagggcgtcacggaattgctgctcatgctcatgctctcggttcacgcgcgttggccgggatgcgcaatcggactggatagctgagggggtgtcgagggcaagcggccgtattcggcggagctggcgagcgagacgacgatgcaaggtgattcctcgtgtagatttggtgaaggcgaatgaatgaacgaaggactggaggagtgcggtgggacgagtcgtctgctgacgactggttacgagggggagagtgcggccgtgtgtgctggactggcaaggggcatgactcgagtgagcgacggcgaggacgggacgatgggcacgggtgtgggtgacgaggatgagggatgaaccaggagagcaggcacaggcaacggttggctctgttttaggcgtgggcatgcgctgcacccatgtgtcgcacgtgactctgctagttttttttttctttttttctcgtttctcctttgtcactcctcagattgcgctctgactggtccccactccgctcagacgcgttgccgacatcccagccgtgccattccatattggcgtgtgcagcacaggactatcgtcggcttttcttttctatgactcgggggggggggggggggggaagaaaagaaggaaatgggcagctgaggttcttgtctctcgtaccctgactatcctatgattcttctggaccttgaagagtgctttcattattcacgaaactcaaggcagcacacaggcgagcactacagaccaacctatacaaccaagaagtggagaagatcgacaaacaccatcgtggtcaatccatgaaggttggaactcaatttgtttgatcggctggccttgggtggtgcgctgtggttggtccgctttttttatgttctggatcggccagtgagtttgcagctttgcctcgctcggcttgacccgcccatttcgatccttgcaaatcgaactcagacgctggaaggaataggaaagttattcttcattccggaccaaaacgcacaaatacaaaaaaaaataaaaaaaagtggacagatctcatgtctatataaatggccatgggagaggctgaaaacgaaaaaacgaaaaaaaaacgtcaatccaccataatttcctcgagacttttcccttaccgtgctttccatatcctccctgtcttacctctctttgttgcgtttcgtctctcgaatccgctctttcaacatcctgtctcccttttctccacaaacaccactctcggtatataaaaagtacacacgacgtgtctcaatccttccccacaaacacagcatatttcacagctcttccccccatcaaaaaattatccaaacactatacacatgtctacctcgaaagataatttcgatctcgagaagcaatcgcaccaactggtcgatcaccccattcaccacctctcgcagcagctgcaactacagcagctgcagcaacctcaacaacaacagctacagatccagcaacaaccacagctggcctcccaacttccactacacgcccacctcgagcccgaggacgtccgggtctctcctttccagatggacgtcaatatgaaccacccgtccctgaacgcgggtcttcaatcctcgactcctcctcccaacccaggtccctttggcctctgcgcctttgcactgacagctttttgcatgggcctttataacttgcgtgctggtgttgccccgaatgctccaggcaacttcatcacaggcacagccatgttctacggcggacttggacaggtaagactcgacatcaaaggcagctccaccagagatgttcaaagcgttgtggtccatattggttgggcaaagcatgattccatctacctttttttattcatcaaaaagtatctcatgaccctcatcagttaattctccatgttcgcaacgccatgcagcctcttccaacccttgtacctgccccctttttattctcacaccctacgtttaagcaacgtttacggccagcctcaagtaaaccacaacatcacaaagtgctgagagcagttttttgttgattttctttggtcgcttctggctgggcagaatttatgatgtccgctcttccaattgacaaagttccccgcataacatgggtcaaaattttgttatgtttctcgaacttccccttcgcaacgctcgagcacatatcgccgagaaatgggtcttcgtttccttcccacttcttccgacaccctctactgtacatcgcccgctcagccaatgataaccatcacctgtcgttaccactgctctttcctcgtcaattacataatgggagcgggcacaaaagaatatctgcgtcgccccccacaccacgctcgcgttctgtggctgacctcctattcccgttcgccttgaactgcttactgactccctccaccccttcgtcctctccctcatccctctaggtgatcgcgggcctccttgaatatcgcaacggtaacacctttggaggcacgactttctgctcctatggcttgtactggatctcctacgcgactctgctcatcccttcctttggtgtcgccgctgcctacgccgactttcccgaggatttcatgaccgccgtcggcacctacctccttggctggaccatcttcaccttcttgatgtggacactgacctggaagtccaacctggcatcgaccgcactcttcttctgccttggcatgacctacctcctcagcaccatctcgagcctggctcatctggctccgggaaatttggtccagaagcttgcaggaggctccggcgtggtcactgcaaccattgcgtggtactgcgccatggcggatttgagcaactcgcaaaactcattctatacgctgcccttgggtcaattgagccgccgttaagttttgaggagccggctgtcacttttggcgacatccagcacctcccccacgttgaggaagggggataacgtccatgaatgccgcataccacaaacatcttccagcattttttatcttttcttccgaatcattcgttcattggattcctcctcctcttcctcctccctctttcctttcacttgataccagtggttttcttcagactcttaataaatccacacatttccttgacaacgcattgactatacaactctatattgtgggtgcacatcagggggggggattatcttttctaatatcatgttgtgctgctacttggccatgccaagattcttcctgttcatacccgccaaacgacttcccagcatcctgcgacgctttccttccaagtacagcatcgactcggcataggtcctgggcatgatcctggacgtgcccttcaccgggtccgtgaacgtgaaccagaacgtgttcgtggtctcacgcgtgcccttcttgacgtccaacacatcggccttgaccatcacctgaaacgaatgatggtcacttccctctgcatacacaatcttggaatccaacgccaggaacgtgccaatggggacgggcttcctgaacgagatctcatccagggccaggaacgttggccgcgacgagatgaacacggaggcgttgcagaacgccagctcataggcaaggcgcatcaagtatcctccgaaaatctagaagcatttccagtaatcgaatcagctgtctgtttcttctattgcgcaggtgaatgctgttgcaaaaaatcattgctggtcgttcatggatgttaccttgtcgtggatgtttcggtcctggggctgcatgatatgaatggcactcattttggtgtcctccatccactcgacatcatcgggctttttggtctttgactggggatcgtcatattgggaatattccaagtaaaggtcatgaatcagaaaacgctcctcctgagtagggggtcgctttgtcaacgcagagtccgttgcgacgcgcttcttggccttgtgatctaccaaattcagttcaagcgttccagggtaagtacttgaagtgaaaatagggcagcccacggacggtgttgttgctaggcactagccaaaaaccgtaccttctcccatctggaacaacttcttctcagtatcgttctggagcaacatagggttaacttgggcagccttgccagtgagggcatctctggccaccatggtgaagcgtgcgaccaaaatggtgtctccatgctttcctggcttgtcctctgatatttcctccatcttcatgaaaactaacaagacaagaaacgcacaccaaaagttagtatgctgttctgtgcaaataaaaatcgttcaccgataggaagatctgtctcaaaaggagaagcgaatcgtcagtagtgcgacatactctccattgaactgtatccgacgtaggtgacgtgtccagagagacgcaggtcgctcactcccaggggtttcagcagatcgatcctgtccaccgaggcagtgacaatggtcagaggcgagctgtcggccttgccatcatccgcatgtttgtaggagatggctcctgccagggcatcaagatcctccatgattttgccatgtctagtcggaaaacgatcaacgacacagtagggatgcacatcatgatgagtacggccatcgaacacatgcaaaaccatgcacagaaaaagaaaatgtaaaaatgtggataatcagtcctccgtctccctgacgtgtgtgtagcctaatggcaccatttcttgttccgcaccccagatctgcgtgctcctcagagagccgccccatttccgctcaacaaaaattagtgtaaggtgtgatttttctacacagaacaaattctttgagtcttggtatcatcacttttcggtctccgctccaactcgtggcgctgaggcggtactcgatagagtgtgccatgcccaacccacgggttctgtaacgccatttttttttttttttttttttgcccttacctcaatgatccgcctacattgatatactcttccagaagcgccttatcggtcttgaatggcagaattatctcggtgtacgaatcttgcatggttttcagaaccagctcgcgcctgttgtacttcttgttggggtcggcgggcgaggcaggcgaggacggaagcgacgtgttgacatggctgcctgtgggtgacccatgctcgcgtgccagcttgtcgatccaggatgtgatgggtcgcactgtaaagacttttccgtggggcaaagccgagttggaggctgcagcagcctctgcagcagccgcaatagacgatgtgctcgatggaccagggcctaaaacaaaacaaaaaacgtacgtgcagaagaagcaaacaaaaatgcaggtcggtatgaagttagtggggactggccaaggctagggtcgaccttggctgaggtcgctgtccacggcccatccattagaaagcgagagcgatctgggcggggatgtctttaaatggaaatgcgtggagtttaaagtgatccgctgttgcgtgctatgattcacagaagcagggcacagggaatggagggagaaggtaaaccaacaacaaataaccagcccgctcctcacaaaggtcccctgtttcctgcctgaacattacggatcaacaaaagagtcagagaggaaggctggggaggaagaggtgtaccatcaaaagagtactgtgtccgcgattaaagcagagaagcgcagaaaactctccgatccaaaaaaaaaccccccacgctctgaggggcacttgggggcaaccaagaagagtcatttacctccagtggcgataacttttcctgaggaggtgctgccaagcttgtctagaagctcgttcctggtcttttcgatggcctccttggagatgggcgtgcctggcttctgggtcaccacctgatcacgcaaagtgcggttggcgccagagaagaagtcgggcttcttggtgttgagggcgcgcttcaaaactgagggtgtgctgcggttgaggagagtcgactgcacccgtgctgaattcaaagcgagggaccgcgggacgctcgcaggtaatgaggaggaggaacggagcattctgattatgttcgtccttgagaataaggaataagggcgtgagaagaggggtcaatcaaaggtcgagtggtggagatgcaagcgagaacgaagaggatgtgcaagggtggggatggtagagacaaaggcgcagaggagaggagagacgagcaagtggaggaggatggacggttgggcgaaagaccgacagcgagagtgaatgctcaaaagaagaaaaaaaaaaaaatctcgcgcaacaacgaaatactgaacgggctaactcgcttgatttcttccgtgctgtgacaaatcccacccttgtttttctttgtgccgggttcaccgcgtatcccgatacaatactgtgtgccgtgcgcgacgggtcgagagggttggcgagtgccgcgtctcttggccatagtgcgactatcggatcggaatgctgcatgctgctgtgtctccaacgcgggcacgtttcatcgaccgcgacacctccacaccgcccccactcgtcgccctattcagcttcatggaaggagcccacagtctctcgcgtacactttcacgtcacgcgctgtggtgactgctggacgcatattctcgacaactcggcgcacgaaccttgttcacacctccatcattcttccttcttgccgctactccatcatctccttcaagtccactccagctcgacgaacacggacacaggcaaacatatatacacagcactgcacagcacagccatgacacgcaaagtcaccttgggcctgatgggcctcattgccctgtcgtcagcagtcaccatggtccacgcacacgaggagcaagtcgagtttcacgcccctgcggaggcagaaaaggacgtccccacgctccaacttgccgctttcaaggtaagcatcaggcttgataaagatgtagtcgctacgcccgaatggcataatcatcttgctcaaccgcgactctgttgcgaccctcctctcctagccctcctctatcaaggccccgttcctggagcagttcgctgagaactggtcggatcgatggaccgcgagtgaggctactaaggagaccactgctgaaggtgaggtcttcagctatgtcggtcaatggtcagtagaagaaccctcagtctacccgggactccagggtgatctgggcctggtggcaaagtcccctgccgcacatcatgccatctctgcatcgcttcccgaagtcgttgataacaaggacaagaccttggttgtgcagtaagcatcgattctctcactcgataaggagctttttgcgacccatgagaattcaagtgactaatgcaaccttgttcctccattctgtcgtgtcttgaagatacgaggtgaaagcacaggacgggctcgagtgcggtggcgcatacatgaagctgttgacggattcgccagagggaatcaagttcaaagagttctcgaacgacactccttataccatcatgtttggacctgacaagtgtggtggcacgaacaaggtccactttatctttcgacacaggaaccccatcaccggaaaacatgaagaaaagcaccttcagtctgcaccagtggccaagctgaactcactgagcaacctttataccttgatcgtcaagtaagtcggtggacattgggaagagacttcaactatatgatttgatagtttccctttctaacccgcaactctgttcccacaaccaggcctgatcagacgttcgagatcaagatcaatggcgacgttgcctcctcaggatcgctgctcgaaagcttccagccccctgtcaacccacccaaggagattgatgaccctaatgatagcaagcctgctaactgggtcgaggaggccaagatcccggatcccaaggctactaagcctgaggactgggatgaggatgcgcccgctcgtattctcgatgaaagtgccacggttcccgaggactggctcgaagaagagcagagtgagattcctgatcccgaggctgtcaagccagaggactgggatgaggaggaggatggcgactggatcgcaccttcggttcccaaccccaagtgtgtcagcaatggatgtggcaagtgggttcgtccttacatttccaaccccgcatacaagggcaagtggtcggcaccttttattgacaacccagagtacaagggcatctgggcagcacgcaagatccccaacccagagttctttgaggacctgcacccctccaactttgacaagattggcgccgttggattcgaaatctggacgatgcaaaaggacatcttgtttgacaacatttacattggtcactctgtcgaagatgcagaaagcttagcggccgagagctgggaaatcaaacacgcctccgaaaagaagcaacaagagttggccaatccagctcccaaggacaccgaggacaactcatcgccggattttagggaggatccttttggcttcattatctaccacctgcgtgaattttacgagctggctcgcgaggatcctatgcatgccatgaacagccgtcctttggttgtagcactgcttgcaggaactgttggagtttcgttcggcctcttcttgattatattggggctgatgagcgctgctaatcccgagataacaccttcacagacagccaaggccaagaaggaggatgcagtgaacgaggacgcttcagagggcaagcaaggacaggaggccaaggaggaatcttcagtccggaagagaacaaccgttgctgattcagacgaatgagagactagtggccactctttcagctttatccgttgctcatcaatgctatcttcgttaatctgccacgttacactccccatcctgttctatacttgcgcgccttcacagccaagcacatggtggcacatggcaggcgactaggcggctcatgccgggtgctggggtgtgtggtcactgcaggagaggccgttgtcgctcggcatggtctactcttttgaggatggagcaaacatcagactacggcgagagatcttgtttagttcaaccgtcttttggtccctgaggttccgagggtcatgggagagtgtgagttgcatgtgtgcgcctgatatgaagagcacctacggcgaggaagggtgcacgagatagcgcgaagctgtgcattcagccgatattatggtgccaagccagtgtttaagtggggaatgagggaagcggtctgtgcaagcgcagacggacattgtcgacgataccccgtttgggcagacaaacagacaaacagacaaatagattggtgcttggcgtagccggtgcgctggcacctttcggaagcgcccgttccttcccacggatccaaaaaggcgaatttgtgctgtctcgctcgctggtgctcaaacgccgtctgcgaggcaagtcggtcctgctcggatcaagccggcactctcgccacttttcatgcagtcgactcgttcggcatctcaactttgtcgcaaggtgcaggacgggcacaagtgcgcgctaaaaagggctcgagaggtcaacgaaaaaaaaaaattcacattctgcttcctcatccatctgtccttctcatcgacattcgttcttggccacacacctttgctttgtataccaacctcactccacacccctcccactcccgctcccactcccgctctgacccccaggatatggacatccaaccatcagagttgccgactactatgcccagttctacagccaccatgtccgcctcgtcacaccccgcctccaccagcctggcattgcccgtatcagtcgagatcacacctgagaacgacccaaacccgtcctggacattcttccctgcgtgcgctacctacatcccgccagttccctcggccacaccctccacagctgcagatcctgtctcgcctgccgcatcagcgcttccagcctcgccctcgagatcgcctcgatcctctccaccgccagtgtcgcagacgtacaataccagcgatggcggcccagctttgtgcacgtcgttgtcgtcaacaccgaccacacaccaccgcattctagatcactgcttccacctctcgattgagacccggctgaaacaggccgaggctcagtatcaggcatcgactcaggagctggctgttgaacagcagctgatcagagagggcaacgatgcagcgtccaccctcaagcaggacgactggcagcggcggcagcggtcactagtggacgaggcggtcgaccttggccgcaagggctcgaatgtcgaggctatcgtcgatggtacggatgcagttgttggaatgttttcctttgccccacccccctcccaacacggtctcagtctgcactcctcgatacacacactccctttcctccctatctatcgcaatagctactggttatttttttttcgggtgtaacccaaaaagatttcctttttattttttcctaaagtggtggacacggctattttggacagattcagttgctgctggcagcttctccccaactggtcttggtcgagcgaggcatcgcactccaggacaaacacggcacgaaggggtggaacccactttttcccgataaaaaaaacttgacttgctaaccgaaagcgaacttatcccccggttttttactttgtcatgacggataggcatcctgaaatcacaccgatccaatgggccgctgcagaccctgccacggcacatcaaacaccggctccacctctgtcagctcacctccatggtctttggtcgcttcgacgttgcctcctccaccaacaactctgcaggactcaacatctactcggccttccactcgcgacggcatggcgcctctcgcgctgccatccgcgccagattcgtcaagagtgaaaagggacagcagatccaggcccagttggacacagaacccatcccctcgtctttgtattgtcgtcgccaccaccgcagagactgcaagcgcacatgctgcacacgggccaagttgcaacaggaacagcagcacgctctggaagcaaagaagaagctcgcccacaactactatatgaccacagccaatgtccgcagcaaacacgaggaccagcacaggcgggtggcgggcatggtcgatgccatacctgctttcctcaaatgttctgctatgagttatcgggatattgcaaagtcgatggttgacaagggagagctcaagagcatcaaggatatgacggtggaggaggggtggtacagactgctgctggagatgatgactcaggccgttatcgagtcgtacctatgtgacgagaacactggattcgagacgatcctggacgtgttctcgttcggtgatgatcccgagactgtcattgattacagcaatcaggacacgacccctgcaacagcatcgactgcaacgacgaacaccaccacgacctcgggggatatcgatgaactggatgatcgttcgggtgcagcaggagtcgagggcttgcatttccaaaacttgagtggacttgggtcgactcctcccagtatgtcgaggcagacctcttccacatcgacagtacttcatgatgtgacgacacaggacaggcaggacgatattctgtttgcaaaaacgccgctgtatgcggcgttcaaaaagtccaaggatgagcgtcttcaagaggtaaaaaataagggaagagagaatgggagcagaggagtggtgcagtctttagaggcgatttgtcatcctctctgatccacatttgcatctctccaagatatcgcgactaatgcttctctgttttctcgctttgatagttcctgacactggacaacaccacgatggagcagcactttgcagacctggcgacaaaatacccgttgatctcgtttgagcggcagatgacgcactttattgcccgttcacaaaagctactcgtggatcctacgctctcgtcagtcaaccaacagcccattggtctgcttatcccacccacgacctctgcgtacgcagacggctcactctctatgccagtgagcgaggatgaggacgacgatgaggaaatggatgaaccatcgatcaagctggaagagatcaaggaggaggaggaggaggacgaagatgaagcgatgaatggggaacagaatcgccatggacagttcccaacaccgccactttcggtagtagtgatcaaggaggaaaagaagagtcatgcgcgtgagccagaggacgaagacgatgacgataactcgactgcagcaagggttgtgcaggtgtccaagaaacacaagcaccacgcaggcgtggacccaagcgcaaaagcagcgcccacggaaggctctgaggatgttagacatactgacaagaaggtcaagatcgtagaataattcaatagcttttttttttgcatatgttttttgtcaatttttttaagcatggttcaccgagtcaggggcaagagactgataagggcagttctgtccaatcagagagggcggacatacatctgatagaactgcttgaacgatggtttgggcgccattcgcgtaagtgttcgatctcattcactcaatccatttgatcccctcagccccatcatcccccttctacagctgcacttgatcgctccttcacccgattacttgctctgcagacccccgtctctcttgccatccataggcctaaacgcacttttacgttcttgttggttcaacacgctcagtacctcagcccttccgtcttggcgtcctctgtcgacctttatcctgcagctccttcattctctcgctcgcaccctcccttccttcgttcgtccttcctcctcctcctttagggcatcttctcactacccgcagcttactcccagttggacctgatatccaacttgaaacgctcgtgtggtcccaacaacgaactcttccccttttttttgtgaaccattctaccacgaccatggctaacactttgacgtccatgatcatctcgcctcagtccatgggcctgaacttacaatcgagctcgtctcaatctgtagcacccactacgaacacaacctccaccttgttgcatggcgtgcccaacttccaggtacaacacgactatgtgccggtcacgtcctctaaacgcatagtgacctggcggtatctgcaaagaatgtatcaaggagggatggtgctttacaacacggccatgttgtccgagaataagctcagacgcggctactctatggacgacaagattcaacggaggtaagcgacgacgaaaagaataagagagagagtaaaaaaaaaagggggggagagaggtgaacagattcaatggatgatttaatatggccgtagtttcaaagaccctgacatgcgctcgcgttcttttctcgtggtgacaggaccctcaactactttctgctgggcacatcgttggcacctgtgctcgagatcccgaatgtgaccgatatgctcaaggctctggtggtggtggcgcaagaatacgaattctttacttcagaatcaaagtccaagatggtaaaaaaaaaaaaatagggatctgataaacaatgtgttttttttttgcagcgcaaacaacctttttgattttgtttttgttttgagcacgcatggtgcaactcacacgagttgacaacatttattttttttttctcgttctctctgtggaatgaatagatgttcttgcgagcaacgagtcgtaaagccctttcgcttgacggtaaagctaccgaggagacgggagagtacacgctcctggaagttcgacagctggtaaggacatctgtccatgactattacatctatacgaacgctgcgtacatttgcatttaagccgtctttcagaggtagcatgcatccaattttgctacactgctctttcctctaatgtgtttgtacgtcatttctgcatcctgctttgtatgtaccaaaaaaaacctcccacaacagccctttcctctggactatgtgatcacattctcgtcgctctgcgatacgatagctcagatatatgagaagattacgagtgaggatcgcttctggaccttgacatgcacagagatgtttcaaaagatcgacctccgtttcaaggtaaatagatatacaggcggggacacaataatccaagctgcaaaaaaaaaaaaaaaaaaggaatatcttaggatgacatcttcctttcttgctccctagacaaagacactatactccgtttataaacatcttccttacttttaccttttgtgttttatggatatagaaaataatgatggcagcctgcaaggagctggagacgatggcgcgtgatacgttggcggatgaactgaacgcaattgatcctctagccgctttctcacaaagagacgacgggaacctgtgagctttttttttttactattgtcgagggcttctacagagtatgtgtatcaaaaaaaccatcccatctcactctctcagacatgcaaaacaagatgtatggtacattaaaaaaaatcagaccacagtaggcatgtcgggcattcagttcaggtgcggggttttttcggaacacttctatactgatgaggcggacatttcgcgcgcttgtcggttgctccaagaagagtcgagtgtatatagcgcctgccttcctccctaaaacgttctcgtcaatatagtgggcatgtttgagtttctcggtgaaccgacgtggttgtaggcaccacgccgagtttgctttgcgtgcgagagataggaggaaagggtttgatccagatctcttcctcgctttcgctctcgcgcccaaatgttgcgatggtgatgcggtccgctggagagggggagagggggggggggacatgattttcaggccgcctttgaacaaagtcaccccttctatttctttcaatcattttgcgtagtaatttattgaaatggcggtggtggtagttgattgttgttgataattgttgttgtaatggttgcttttttgttttttaatgtcacttatcgactagggtcgatgtctaaaatgtaagggatcaaatggtatatatataaatgtgtcttggggagtaagatcgacaaagtgagatgcaaaatcaaacaaaaaggagcgaaaaaaaccccctgaagtgggttctagaggatgtgcaagtgcccgagtcaacggaatgcatcgacacaacttctcagcgtcgcgcttgacgcggactactactatggttttgagtcctaggcgaagaaggcgtcgatcgcgacgacttttgggacccggccgtggacgtaaaagacccccgcagtttctgactccgggccagtgcagcggggtggcccatggggggtaacgtgaaagagtcgcgcaaggcggcggctgtgggcgacagtgggatgtcagttgcttgtccgtcagcgtcggtgctggagggaggagtcacgtagccagagccagctggtgcgtgcacgtgttcgtgatgtggatgctgtgatgatggtggtggtacaaagtagtttccggaggctgtagaagtgccaggaccggcggagctggtaacgggagcagtggccgtagccgatgggggtgaaccgccaatgaccccgcccagtcgactgttctcagagtacatcatgttcggagaatgatggagttgtagtggctggtgatcgagatagacaggctgaacagcgattgtgccatcgggcaagtgctgcatcagatattggacattgcctggcgtctcaatgggtccgcttagcacatcgtcgccgctgcctggtaccgcagctgctgctgatgtatagctttggcccggagtgttgaccccagcgcccaccccattgagcggctttgacgacgtcgagaacggagacgatgcagaggctcgatatgggttattccgatggctgcgatgtcggcggtgatggctgctactcctcctatcgccagtcgattgaccatcggaccccagcgaggccaaataggcccgcttttccatctcggcctccttgacttcgatctgcttttgtcgtttccggtaaatgagaaaaccaatggcacatgcgatgagcaccacgacagcaagaacgatgccaatcacggctccaactgaaagtccactcgtgctcgatttttctgggacgtggccagagggacctccggggacgggctgcgatgcaggagtcgtgtcttcttttggaacgtatgtcgtcacccatgcagactgcatgacatcgtaaacctggacgtctttgtagtagcccacctcagtggttgagtttgccgttctcgcgcgtcctccatagacaatcatgttggcaccggcgaggttgcatgtgtgcccatatcgaggttgcgatggattgagtggcatgatttgttgccacgtccatgtgttgagatccaacacccaaacgtcgttgaaagtcgaagggcccaggacttcatacccgccaaagacgatgaccttctggctcttggctgcttagagatggcagaaaaagagaggggcctgggtaagtatctgagatgcaagccaaaccgcttgtggctgaaactggcaagcgtgtcccctcccgccattcatacttaaaacgctgcagtggtcttgtcgaggacgaggcaccggtcccaagatcaactattattgggaaaaaacagagtgatgtaatgttagttgtctgatccgtacaaaacctatcccggcaaagtgagcattcaagacagccatctcaatgtcttttacctgcgtgctgattgtaggcgtggctgtcgatatatcaatatatggtagattttggaagctttggtagaccttcgtccctgatcctgatgaggagaaaccaccaaagagaaagatcttggatcctacgaggtgggaggtccctgcgctgaacctattcatgagcgatgtcgatccagtgccttcgggtgcgtttgggtacatcgttgcaatgttggcgctccaagagccgctcatatacttgtcaatttcattgatttcgacaccggttggcagtacccctccgagataccagagggcacctgtggtgggatcagtcagcaactgggcctctcgtctatttgaccacaacgtcgcttggctacaagtggaaataaacgatacggattttagttgtaaacccaagcgcgtggttggctggggtgttggggtgatggaaggcgcgcatgggggatacacagaaaataagaccttgctacaggagatgccattcctacagtgcaggatagggttgcaaaagggcgatcacgaagactgggagaataggagttgctggtgatgaactcaaacagctcgcggggttcacgaggctgtttcaaaacgtcatggccctaagcaccccggcgccagaaaggtaccacgttggcgagagactagcgaatctcactcgcccaatgaactcaaaatttttgtggtatagggcaagggaagggcaagggaagggcagaacggatggtatgctccgtctggtagtcaagtgcagccacccactgagagtttatgccggcgcgcacaaaagagaggcagcaactcaatctgcagcggagatgcctgccagcacataaggataatccatcgttcccttgggctctcaacgagccagaggcattaaacatcttcaggaatggggccaatttcgtcaccatcgctctgtcttgtggaaagagcaaccttaaaataacccaaaaagaacacttacgctgcaggtgcttgctcggaagaccatgaccgggttttgacattgtaggcatagaagaatggatttgtggcgtttcctgagggtgctgtgagatagatcgtcgatagatctttggacatggtcgccgagtggcccgagaccttgggtccccctcctcctgcaagcgaagtgaggttggtccacgccggtagtgagatgttccaccgcactgaagtatcaatcgcgaacagctcatccgaaaactcgactgtcgccttgttgagttgtccgccatgataatagatcgccccgtcacctgttgctgaggcgacgcccaaaaacgcactgggggcctcgacgataatgctggggaaaggatttacactgctggctgttggggttgtttgtgcgtatgttgtcgatatactcaaggacaagatggcaagggcgagggtgactttcgccacgacctgtgccgtcgtgcgagtcctcttttgcatatcctgcgttgctgtgttatgacgacaaccgactgcgagggagaggacggcggcaatcgagggggagcgtaagagaatgattgattcccttgatagaaagaagtgttgaggaagggccctgagaaccgaagtgtaagaggaaccggagcgagttgatgaagtatgtgggaggtgagggatatgtgctgtggttatagattttttttgtgctgtcaggggtatatttcgatgctcaggtacgaagggggacaggctcggcgagaaaagggagagggaaatggagaataggggtgtgatcgctgattgacaaattcagcggtgatggaggaggaggatgggggactgagagaagggatggggtgtccttttcaagagtcaagagaacggaaggcagggagagtgtgcgtgattcaacaaaaaaggtgtgcctggaaggtcagcggaggagtttgtattggaaacagactagagtgtgcttttttgctggaacggtgtgctgacggaggaggtggcaggcaatggacgcagcgacagaggcaggagcagaatggcagctggatcgagccgtgtgtggaggaggaatgaggatgagggtacggacacgatggaaggacagaaggacggatcgttgacggagaagcacaatcagacgaaggcggcgagtgtgagaatgtgagagagagacaatcggcgtcaaggatgccagcaatgtcagacaggtgttattggccttgcccttggccggctctctatttattgcccactagcgtgtttttcacggctctcgttgacggcatcagacgtcgcaggaaaacgagagaaggagcatccctcttccgcgagtgcatccgctcggcacaggccgtccttcagggcatcgagaaccgggccatctgcaggaacgtaggacaaggcagagtcctggccaccagtagctcgtggtccgcacattcctctgacagcggccttgcctgagaccgactctgcatcgtacacctggctctccaacaagacgcagatgggtcctaacgggccaaccagctttccagaaccgtagtaagctcgttagcactcggctcatgactgaaccttgcccattgctctacaacaaacagcaacagagtttgcacagtaatgaccttcaacctctcctcgacatcccaatggctaatcacccctcgctttgttttctcgcatcgtccgctcacctagaacaggtcgctcgctgtgcttttcatgaaccagaagaacgttcccgaattgggccggccatgtgcgggtctcacatcttgagattgaggcgtttcgccataaggcctcactcaaggtgttactcgcgattcatattttcggcaatttggggcaagtccgctgcttttgccattgtcgctcgacagattatggcgcacacagagcgcaccatgtggccttagttatgaaagaaagagccggctccgcatggagaagtataccgatgagaactttgtcggcgacacaaatcaagaaaagatgaaattgacatcattagccggctctgcagctctgttgttcatgctgaatgaagtcatgtatggacaaagcaagtgttttataccactgaatagaccaatgtatgtatattgcagtgcatttgtattccacactgcatctgcatgcatgccatgcaatttgaatcacaaatttttgccccagcctacgagccatgaaagaaaaagcaaaaatgtccctggaccgatgatcttctccgcttacccctcttgcaatctttgtgtgaccatagcccactagggcacccacaacagagtgttctcaatcaagcttaataacgcagagaacaacaagagcttgtgtttgcgaaaagcaatactcccagtccacagtatgtactgcaaacagcaccagtgagagccctctagaggacgagcagtccttgcatgtataagaaatcatcaagtctacaataacaagacaacgtgaactagtctgctgtcgtttccgaagctcggaactttactgaggcgctatatggagcgtcttgttaagacaagctgcttcccttttgagtcgtggggtttccctcgcatttacaactgggtaatcattgtccccacacagaatgtgcttcagaatgtgcttcaggtaatgctgcccatcggcagccaaaggagcatgctctgtaggtggccttgagaagactgcgaggaatcgtgagtgagggctcacccaagtgtaattatcaaacttcagacacccgcctatgtaagcagggaacgggatattcagatgggcgaacagtggattgggaagaaggtgcagaggtgaagcgcgtgcaggtttttattatattttttttttgtaattcattgcggttttctagtaggaacatgggtggagcgggaaagcaggagagtatgaaaaaagttcagcaagagaatgagtcagggctcgtacgagctcaagcacgagcacggtctgcgacgacgcgtagtagctgcacagctggccatccgctttgttcatatgttgcacaagggcaagtgagcatctcgtgccatttcaggggcgtggtctaagggcatcggtcgatgtcaggggcagcagtgagtcttgagtgcttgcttgcccacagcggacgagcggagtgatcgggccaatttacgctattcacgctgcgacgccaaggcagccgtgctgcagccagaacaccgcaaccacatgtcagcgcgcgatagcgggagccagggggggacatggacagccagaggcggctgagttgagtcgcactccaggggcaacccaggacaatccagcccaggacaaggccgatgtttatttttgccggccgtgtcgacgctgtcatgtcggcgtatgtgcgctgcagacctgcatcactcgtacaagccgccttggcctcatcatcttgatgattccaacacccccttgagcattcctctcttcttgaattcaccacctcattctcacttctgccatctgtccctgattctgccactgccctccaacctaaaaaacaaacgactcggctcagcctataaagaacactttcttttactagcaccatgggcgccgtttctctggtgcgctcgtcctgggcgcttgcctatgcggcctcctcgctctcgaccctgctcctgacagcagccgccatcaagggcttctctaccaagaaccggaccgccaacatagttctcactctgctgggcaaccaaatggcagagctgcccctgaccgtcgtgctcttggatgtgattttctcgatctggctcagaatcactggcactttccgtaagttcccacgcttacaaggtctagtcgggggatcatcgatcgatcagactcgacaacattctcacaaccttcatcatcaatttagatcaatctactctcgcaagtttcttctactacatcaatatcgttaccgcagttggactgttgtacctcctcaaactgtctctcgacgccaaggtcacggcgcaaaagttcttggatcagctttccaaggagagcaaggcttctgtagtactcccgggactggacgcgtaagagcggacctggcaacaagcaacaacgtagaatgaggaaggggatcgtcggaaaagtatgagttgtactaacatctcaacaccaccgcttttgtccctaacctagaccaaggttttggaagcaatttctgaacccgctctattggcctcaaggatgcacgatctacaacaacagtaagaaggaatgcaataactgccacaatgtgctaagcgcaatttcactagaactgactctattcgactgtgatatatgccttgcgcccctctgtagtcccatactggaatgagcgcgaacaactgagtgctcttcgaagcgacggatgggagtctgtacttcagatggcgcttgatgtctacagaccgaatactgtcgagggaggcgataacagacccgttctcgtaagtatcccgttatcctcatgagcaccaaaaagagactgtttgccgatagaaaccacggtattcaagccagcacattgtactttatgatgttgacttgatccataattttagatgtatattcacggcggcggatggacttcgggcagcaagtcgttagtaggaccccttttgaccgagatggtgtcccatggttgggttgttgtatccattgatcaccgtctcacggccaaggctggataccctacgcagttgatcgactgcaagagggctttgaggtggatcaaggatgagatccgtatctttggcggcaaccctaacaacgtggtcgttgctggtgattcttctggtggacacctggctgccctgttggcgttaacacctaacctgcccgaattccagccaggatttgagggtgcagacactagtgtgcgaggctgtgtggctcaaagcgcgtcgttagacttgactgacctcaagaactatagtcgacatgagttcagaggacgttttgtcaagaacgtggctaagcgcgagggatctgcagcgtcagaagagagtaagttttccactccgctttcgagcgtggttagacttgcgtacttgaaagaacgatcactcatccaaaattgctaatatgtgttgcgaccctctttccattttcgcgccctttagacctcaagtttttgacggagcactcacctttgttcaggatttcaaaggtcgctgtaccttttcttgtcatccagtacgtcaagcacgcgtaaacgcattggtggcgttaaggttgtactatccaatgaaactgacgcagcactattccgatctctgcattgtccccatcatcttcatcttcatcctcaaagcggagacctcgatatcatctcgcctgttcagtcagcgcgtgactttgtgcaagagtttcggtccagtaagtacttaactcatcaagccgtatggatattcagctgacgacacctaaccaccattcacttgcctaatcttccttagaatcaaagtcttcgatcgactatttggagctcgctggcgcccaccactgctttcaaatggcctcctcacccagatcttggtacacgactattgccactgctgagtggctgagctttaaatttgatcgccaaggagatactaaacaggctgacgaaaagaaagttcaggttcacgagctcgtggaatggggttggactgcatagacctagtagacgtccaaaagtgatcggtggatggaataaaccaaaagacaccatagcgtgatgcatcatcgactttcaaataattcttaaccgaaaccaaggatgatctcgttgactttggctgcactgctgaagttctttacgcgttagagtaaccttcggtgagcgcggtcgggtaaacatcatcgtttgcacgcggcgatacaggaaataaggtatgcgagctgtgtcaaagtcgacgcttctgttcatcttgaacgcgatttcaacggcacgaagcgagggttcttgcatttggcgtatatctctgcttcgaccctcgtggaacgacgatgcaatcagaagggggcgtggagcactgcttctggaagcattagagtttctttcggaattcttgcaatgacaattgaggcgaatggttcaccgcaccaatgcccgatactgcacccctcaccctgtcacgcgccgctctggaggttctcatgaatcctctttccaaaagggtccagagggtctttgcaggtgcaacagattcgcgtttgctcattttttttttctttttgacattcgtcatgaggttccacaaagacacaaaattgctcacaactttttttttttttaattttgtcgactcttgtcggcaaaatcaatgtcgactatccgtcttctctcctagccacggtataaaaggcaatctttgcccgatatattcaaacgctcatcaactcttcatatccgtaagagacataaccatcgtagaaagaaaaaaaaagagatgccgcactttacaaaaaccgctggagctttcacgttggagatcctgcatgagcactccatccttgtccaaggcctgcaaaagccactgttctatggaactgtggaatctccagcaacgatccatgcacgcgttgtcctgaacgcggatcgcgactacaaagccaacacggccgaggttttatttacatcgagtgccggtaccaggatcgatactgttggtaaatgaattgtttcgaccacttccaacttcgcctatgctcatgagtatcaatacgttcgtcttgcttgatacttattttctttttctttttttttatgcgttcctgcttttgtttttctttctcgtcagcagcagagagctactgcggtgaccttattccgggcggattgacctctgagcaattcttcgcgaagcatcgctgggatattccagtcgatcggcctatgcctgggaccatcagcaagggagcctacagtctttctgtcgaggtgaccctcgacccacaattaccgtcttccaacgcccatcaaagcacgtttgtgaagcatcgattccaaatgacactccaggccaatttctctgccgacgcccagtcccgaacaatctttcatacactggatcaggaggtgtgggtcctcaactcgagcgttcccttggcggacacgatccaggagaagcccacacgggcgttgacagaagactgttggaaggaacaatcgttgccagtgtcggtgctgttaccttccggaagactgacggcaggacaggtcgtacccgtgaccgtcagcatgtcatcgtttctgaaggggagtcggttcgagacgcaggaacccatggtggtgaagagcgtcaaatttgcgctggtagaaacgcgacggattcgtgacaggaatgattataaccaaaccccggatgctgtgagcgaggtcctggcggtgcacttgaaggatggctggctcaacgtgcatgacccctgggagagaactgtgcatgtgacgttgccaccgtcgccgacactgtcgatgagtttgacctcaaagtatttggacgtggagcacgagctgctggtgacgatgcgcttcaaaggagctgggctgttcaaaaagtcggaagagtataccatgcgaggtacagtgataaaaattaggatgatgaataatgaatgatgatgatgatgatgatgatgatgaaacgaagaaagaaggggggatcgttctaggctaacgcttttgtttttttcaataatttcatggtgacaccagttaaagtgcacattgttgcaccgcgacctgtgctgacgactcttgtccctgaatactcctcgattagccctgctactttctctggagactctgaaaaccttccagcatatgcgtagaaagtgaatagacgtcattattctcgtaatgaaactgctgttggaggtgaccgagtcatagaataagaatgcatgagctgcagtttgaggcttcattgcacgaccagtgactaacgcctctattcgcagcctgcgatccgagccaagaaaccccatcagcttctttgatgtgagaaaaggcagattaaccggataaatagtgactacaagatccttcaacttgcaacatgagtaccagcccgggctcatgtcgtggttctaacacttggcaacgacgtgagaccgaccattcaaagtacaacgaatggggcaagttcctctgcactcagcatcaatgctactggctcatgatgccggatttggtaagatgcgatgtattatgttgactagtagctgttgtaaaggaaaaggccattaccatagccttggctgaatcaaccgatgattgcccatacaccaagttttctgaattccagtgaaacatgatggttattcgtgtggacgggaggaggacgcgaccgaactactgtagcaggtagacgctgagcgatatgtgcaacctactaggcctcagtctttggcacgcttacaaagcatcaatgcgtagacacgaacgatgccactgcagcacctttccttgtcttataactcatcttgcggatggcaacttgagccaaaggaaccagaacctttgacaaaactattttgccacacgggccaaatggcaaatcatcgcacagtgagcatgaatgtttttgtacgttcacaaagtgatacatacacgaatgctggctgcaagtacaccttgtaggagatcttcggagatatatagaatggcaagttgttcaattcacattgacgtgattgaacgtgcaatcgatgagatgaactcgaacgttttctttttttttatttttaaaaaatggaagagccaaggtcaccactctcattgtcgctccttttgttattcctatttttccgttacggctttctacacctctggctttgttcaacatgttcaccaagatcgaatgcaagacacgataatttgtagagattgttggacaaagtctcatcgcaaaagtctgatctgtttccaattgtacgggccatatgtgaacccgagtcaaaagcaaaaataaaacttgacaaaagccaacagaatgtggggttcctgccttcggttcctcaatacgcgcgaagaaatgaacttaggagccaatgtaaggagacttgaaatcgctgttgttgaaggatgcatgaacgcctcacatataccccatcctctcctcctcccccttcctgctgccacgcgcagattgtagtcattattcctagaaatgcacatttcctttttgacagcgactcctcttttgtggtctcccttcacgtctctccctgatgtgagaggataagaggaatgctcaaaaggagagggccaaatggaatcaacggccgttgaccctacaatggcgtctcacttcgacgcacagttgacccgtcaagcacaggtcacagcgcaatggcacttagacttgtgatctgcagctgcagcaccttagcaaataccgatcctggcctttgaatggttcatttttccaagaccacttcaagaacgcatgaatgacagcgaaaaaaaaggtagcgcagaggatggaactgttgatcgctgccacagggtttttcatggaatatctttatttttttcgccagtcgtatgtcgcgattcgacaaagagacgtccgaagtgttcacgaagatcatgagcatgcacacaagaggttcagcgacatgtaaccggaaaggttcaaacaaaaaaagcgatggcagctttcttgattgcccatggttaccctgcactgaatgaggaacaggtaatgttattgctgttatcggtctttttttttttgttcttattcacgcgtggtttgagtcgccttacgcgggctctttgtatgtggactctaatgcatgcatatgcgtgcgaatattaaaaaaaaaaaaaaaaaaaaaaaaaaaccttcaatcttcgcttctcgggtcccgtaaaggatatgttgtgaacagttcagaacctgtcatttcctggcgattttctgacaggttgaggtctcctatcatctcttagctctaggactctgaacttttgattttgtttgacaccgtggacgacagtactgtattgaaaaaacatctttgggcccttatcatcgacacctgtgacctgtcccaaatgttgactggccacttgccgaaaaagatctcgatttgaagtgaagggaagagccttgtgttctccttcaacaatcaaatccgacattgggtgagtaagatagcgcatgaggtccacggcgatgcagtcttttgaggaccgtggtccctagacaatgctaaaaaataaaaaaataaaaaaagcaggggtatctaccagtaggcggacacaggaacgcaacaaaccgccctattgtattgctgttgacacgaaaaagagatggcctattgcgcgatagcgtgcattgatgaagagaggatcactgtctttggttgaaccacgcattcatatttttcagagcagcatttcgctagtcggtattgagggggcgtttattattcttgagccatagatgcctttactatcaagattataggttgaacgatgctgaacttttagaagtgacaagttgagtaaattgatttaaaaagcatgtctttggtgcggaatgtcgtttgtcttaacgtcttcacgtcatcatattgcacgacagctcaggatcgactgaaagcgaaacagtcgtgtagatgatctttatttaaccaagacgcgaacctgcaaacagacaaggctcctggtatgcgaacatgaaggtgcatggaacccacgcatcggtgttgaaaggagtcaaaggaccgctcttatcttttaggtcaaacgagacaaaaaacttacctttgtctgttcttagcgacgaaaagtgtaagtacacacagagccaaagtatcaaagagcgcgtttgacgatcttttcttgtagaagagagctacgacggaaggtggcaataagagacgaagacaaagaagagcaaaaaaaaaaaagtaaaacagacactctatcggaaacgaaggcgagcgatcatcatgagaagagcatttctggctttgctggtcaatccaggaatagcgatagaatctgcactgagtcgactcttcttatgtattcattagcacgatttttgcggctgtactggagcatctcagccctgcttgttgaaggggcagaacagtaagtaagcatgaagaatcagagaaagaaacaatccagattgcaaagtacagatggcggacaataactaataaaagatgtttggtgtcttgagtgttcagcaagaaaagtcattcaagctatcgcttttgttcgaacatgtcgcctgcgaagccgtttataatgtgaatacacacagcttgaaagctgtgaagttggtcagtatattcatggcattttcaaggtgaaaagaaccagtacgcattgtttgtctcttgatctgctgctatgtagctcttggacgccccaaacgttctcgagttcttgatttatctgcgcagacgaacacatcaatcgttctcccagaacagggtcaccatccgaaacagaagcagcatgatcaaggtagagtgcagtttctttttttttaataacgaatcgtcatctcaaattcccgcagcaagcgttttgtgaagtgaagcagcatgctggagttcaatacctgaagaggggctgcctgaagcatttctcaaaaacataataatactcagagacggcgccaatgctctgaaggttgttttggcatgtttgcgagcaagctgtgcccagtgacactccggtcgacaagtgggcggaccctggtgcctgcactagcgaaggacgattctggctaacacaccacctgtgggagtcgatgacgagaagttcggtcagccagtctggacagcatataggcaaagtgacaaagacaacgacaaggacgaaaacgagcaagatgaggccgaggaacatcaagcgatacaatgtgtagacgaaacttatctttgatagatggagcgagcatacgagacctgatagatgctagtggagcgacaggcacaggcatcggagaaacacttgagtgaaggaagtaagtaagtaagtaagcgagcgagtgagtgagtgagtgagtgagtgagagttagggtcagagtgggagtgaaagtgggagtgagagtgggagtgagagtgaaagagcgtaaccgaagagtgaaagtgaaagtgagtgagagtgagagtgagagtgggagtgagagtgggagtgagagtgcgagtgaggatatggctattagcagtgtcttgatgctcgttgtcgtagttgacttcgtttggcggcgatgcgacgatggatgattggcaagaggccagaaggacgcctatgggggacatgggggcatggacatagggaaggataggatacgacgagctcgatgcgatgcaggcagcaacaggcgagtgcagataagcgaggacgacgacgggtccagagacacccttggaggaagcagatatgtcggaggatggtgatgtggaggtttcttaaacgaattgcatccagcaggtagcagtataaatacgcaaggcccatccgcgcccgtctcctctctttcttttccttctgtcttttttatctctctctctctcttgctcttttgttcatttccaccccctccagcactccaccgtctcttgcgtcgacatctgctatcccagcccatttttctcattttactttactctcagtcactcattcgacctgcgctctcgtttaaatatattttttattctccttggccgtgtgcccattcagtcgactattctaaaaggaccgcccccccactcactcgctcactctcaccctcatcgctcgctcgttacccccactggctggctgtggacgtgattgtgcgcatcgttcctcgtccctcataccattcgacacatactcacgctcatcgaccgactcacttcctcgccgggccagcagccatcccaagagtccttctttgctccctccctcgccttctcgcctggaggcgcctcctccaatcttgtctatcgctcctctctctctctctctctcgcacaaccacaaccgagacatacacacacacacacctcgcagccttgcatcgtgcacattgccgcccttcctatctcgaccgattagctcccatacttgttattgcacacatacacctttagctacctactgcactgtcactttgctgcatcgcgctaccttacttcatcgctactcggctatcagccagaaagaagaagaaaataacaataattcaacgccaacagggcgcacacaagaccaaggtaaatgaatgaaattgtaaacatgcttagcaatacttccccttcttatatagccatttgcatctagctgctaagcatttggatccgtgtctcggcatcgtccaggcaaacatccagtctacctgctctgactgcgtgtgctcgctcttgtagcgcacacgggccaagggaggagaactagaatggatccataaacgagccaaagaccctgacatacacttgtgttgatgtctttcattatgtacccttagataccggtagcagcgcgcgccgcaacgcctgtttatagctcattcttcatcaattgatccacaggcaagtcttgacaccattcttttaggggagattcgtgaacgtcatcggcatttgagctggctttttgttatctcaccggtgcgtggagtgagaaaaaaaagcaaacaagagtggatgcatccattacggcaaggtcatcagaagcttgtccatggtgtcgagaagtggctgtcacattgctgcagcaacaaaggtggggcagcatggatggttaacgggtgctcactaccactgatgggatgttacgaatgacggcttttttcggtcatggcatcgcgttcatacgctcaacccagtgctaggcgatgtaagaaggaaggagacaaacaaagaacgaagagtctgttgattactgcgaggcaaagttttaatgttcagcagggacggtggcagcagtgtttccgaaggaatactgcgtcacgacctcattgtcttcaaatgatgcgatgcctactgtgaacaagaaagaaagaagcccctttgtcaagacgcataggcacgacagtaccttgtcgagtgtgttcatgggtcggagcgacgctgagcggatggagtccgaggtgggatatgaaacattgagcttccgaaagggtttccataccctcttgctcgggcagctactttgggtgtctgttctcttttactcttctagcggcagatgggttactgtcgtttgaatgcatcatgcagaggcagttgacttttggggcgagtgctgtgcttgtatgcggatggatggtgtactgtcgggatttactctttgctctcaggttgaggacagccaaggtgacgatctagactttgggtcatttccccccgaacgctaaagactaatgcgctgtatactctctcatttccagttacggacagcctggtttagtgccaaacggtagggacctcgacaagaaaggtaagactcattgcagacgcgaccctcccctgtgatgtcttcatttccagtgtgtatatgactgcaaggtgtcatgtatcaacaagtgcatttattgtcttctgcgggatgacggtgcgctaagggccgtgggtgcagatgatgctatgaatgcgcaaggtgttcgttctgcgccgttcactttggtgaccgaagggcaggaatctcggtcttttgcacttctttggcgagcagtctttttgagaacgctgtaaaatgactactcctttcgcccactctacacctgtcttcttgatgacacaaaccgatcaattttcgtctgtgagtcttgaaggcgtggacgcgttgtcaaagcaagagcggccgtattggaagaatgtatcagaatgtatggttacgttcggggtcaggagtgcagatggtaaaagaagcaggcggtaaggggaaggggcgtgctcaagggatccgctcaaaacgagaaaggagatcatgctgcgaaatcgggttaacgccaattaaacgcagaggaaagcgaaatacagacagtagaaaggcgggagatagttggggaaggaaaaaaatggggacactagaccgaagagggccatgcggtagagcggttggtgcgcgaccttgaacatagtctttcgaacgttcctagtccactgcgggatgccctgcaaaggaagaggaaacaggcaggcagagtggaaagaagaatggggtcattgagcaaacattcattggaatgaagtgtgggctcattgctctgaagtgtgcgtggaatcggccacgatcctctctccttgtcccgagataattcccccagaaccctatcaagcaagcacattcatttgagttgggtttgctggccaagcccgttcgaatacctgtctgcttgcgtctgcgcgatagatggtcgtggcgacttggtcgggggaggccgtgggagtgtggcatgggtgtccagccctctgacgaggcgattgctgctggcgcaatcatggttggcgtcatgcaaactgtccgtagtgattatttcttgacacaatactttatccactttgagcttgtccctttttgtttacgctcctccattttctgttcctgatagatacccccaccacagaccacaccaccagagccttctaccactctttatcctgaaagccggcgactccttcgagcagtcagtgtcatgcagtccgatatctatcatctgccggtcagcaatattgcctaccatgtctacagtcggaaagaggaacaggcccgcatgcaggccatttcccaacgggccttccagcggaccatggactcttatcacgagcacgaacaacttgcggatcttttccaggtcgagctggacaagaaggagatccagcggagggaacgcaaggaacaggacaagttgctaaagacgaaaaagtcttcgaaacggtcaacgcagagccgtagtcaggatcgctcctgctcgcaactacaatatccggtactgcccccaccgccaccacaacctgaagcccactcgctttatccacaggcgacggccttaggcatcagtggagcagcgggcgtcaaacttgagccagcgtcggatgttcacaggacaggagagtaccatggcttgaagcgcgcacggcgaaattcagatattagcagcagcgaggtcagcgggtatggcgacgaggagcttggacatcttggttcaaattcaaagattgcgtctttgcagatggtccctgcgggatcatcccgtcacgccgaatgtaacatcacccgttctcgatcgaatgagcgctcgacttcgagctcaccggcacttccaattacaccttcaccgcgcgttacgccatccgatgcaagggagaggaacgaggatgactctgagcatcgaacaggaatgggctccgtcactcgatcctccacccagcccgaatcgttgggttcagctcgtagtttaaccctctcaacacctcccggtacgacttcatcatctatccttgcactctcacaggaagcaaccagtggacgcagaaagaggaagcaagccatccctgtcaacccgtctatcgtagagcgcatgcctgggatcacactaaggattcagcgggagccgcaaggtagccagctcgaggtggaaatcctgaagaacgtagacgattacggttgggacccaatgggccatcaaagttcgcactcgaatcttcaagcactggacgatatccaaaaggttgaggaagccattagatctggacgtcaaccgatgacatgcaaccgccgagtgtctgactggaatagatcactctcaaactcgcttgcatcactcagctggtcgacgaccaacgccagttcgtcaacatcgctcatttcgatgcaggatctgatcgacgcccggtcgctaccactttcatgggagaatttttccacccgagagtgtgtagtcaacaaagtcaccggcaagcacgacaatgacttgcagattttggaggaggtggttcaagggaccattgcgagacaccagtacagtacactggacctagatgacgaactgccgcgacaaaggggacgcgatcgtgaggtgagctcgcgcacttcgaccaccccgaccagacgaaactctgatgcttcgactggagcaagtattgccgccgccgccgccgccgccgtaagcacaggcggtcgggcatctaaaacttcaggaacatcagcaccagccacaacgcgtacactgcctgctcgagcaacccgcagtagaacacatgtatccaaggatggccggggcgggaagagaggcgttgcactctatgcgcatgacgatcttgacgaggttttgaaacacaagcgcaggaagaaacttgcggagcgcaggcgcttgggtagcaaggcaagctcaaaggacgggaccgacgacgaagaggaggacgaatacgccgacgagaactgtacgcaaatggaggagggtcgtccgacttcgaaggccagcaaagtcatgagtgaaggcgagcaggaggaggatgaggacggcgatgtcgttatgaacaatcgtaggaagcaacagcgaaagcgtcaactctcctggacagacaagaaggtcaccactgaggacgcgcacaagtcatcaggaaagctctcgtcagagaccgtcgacaagcgtcgtgtgtcacggtcaggtcaggaggagatcgaaagctccaccacatcttcgagcagcgacgttgacaactcagaggacgactacctcaatagtaaggagaggcttgcacggaacaggagacgcaccaaagtgccgaagggtcctttctcggttgctgatgctggagatacctcagtcaagccaaaggcacggagaaaatcagagtccgatactcgcacacctctgcgaccccaccatattgttacgactgcaaatgcgccaccgttggaaagtatagcgggagggcggcggaccaagaaggcgtggggacgtgggaggaattcaagaaaggaggacgaggtgggcacaactaccgacgacagcagcgatgatggcggcgaccttgccagagacgaggatggggatgatgagaaggagatgccccatggtcgacctgctcatgctgctgtagccgcagctaagacacagggaaccgcacacctcccaacatcaacggctctctcgcaagcaagcaggaccagaaacctctcatctgttgccggcacacctccccaaacacccctgtcggcatctagtacttcaggaatcaccctggattcaggaggtcgtacacggggtagaggccggtcattctcaggggactcgagtctgcaaggtggtgataagaatcggttctttgaccttgcattggatacaatgaaccaaaagcggcgtgatgcgcttgccaagaagcgggcagccaaggtcgaagccaaagggcgtgaacagcaagagaaagcagacaaggagcgcctggaggaggcgaaggcacagaaggttgaggcgagcaatcttccaaagtcgtcaaagtcgctgccaggtcgtgttctccgaagaactcggatggacggagccgcggaggagggttctgtggacccggactgcacctcttgccgcatggagctcacggccgtggacaaggacgcctggaaaaccgcgcaagagcaaggcaaaatccagctgccaaaaatgtggggcgtccatgctatcttgtgtaccttgtgtcgtctgcagtacctggatcaccattcgcggtgcactgcatgcttttacgtccctgtgaaagaggagatggcctccactggttcgtcgtgcatccgctgcaaggcaggaacgtggttgaccgagacggcgcggctgccttctgtagagcctacaggcgacgcgcggaaggacggccgacgcaagaccacctcggaggctctgctgtagcttattgttattgggcctgtgcgccaactcctgcgcaataaataggcaattgaacgcgtgtaggccatacaccaaggaagttctgttggcgttgctttgatctccgcttctcggacatttctttggaaagaaccccaatccctccgcccatttcaaactcgatcgcctttacacaacatcatgcttcgccaggtcacattcagggcagcagcagctgtccccagaggtactttccgatagccagcatagtcctccacattacgagccgcagcacttcggagtttttgatttctgctccgaatccgtcatgggaacatgtgccatcacggctcgaaagcaaagcaagcgccaagaaaactcaagcgtattcactccatcttttcgttcatgattcaccgtagcgcaaacccgtctcctgcttccttcgctgtacactaccccgctccgcacccttcacgcctcttccgcccactctgcacaaaacacgaacgactaccgtgcgaatcgcgaaaaattcccagaggacgacctctcgacccggtacacggagggtccgggcccttcggccctggacaaggcatcgcagtcgcttctgctgacggaactggttcgtggcatgtgggtcgtactcgagtccttcttcagacctccatatacgctcatgtaccctttcgagaagggtgcgctcagtccacggttcagaggtgaacacgccttgaggcgctatccctcaggtatgatttttcttttctggttgatgatgatgatgcttccctttctttatgccttcccgtccggcattttcgatcaactatcaggaatgtttccgttggttgggacatctcaggagggtaaaaaaattgatggtcaagagacgtcaggatacggacggacggcaatatctttcaggatgagatattcagtgaattacttcggagccgctttttttttttaggcctacgattatttgatgggacatgtttgtggatcgcgcttgacccatctcaactcgactgctacttggaggaccttggaggaccttgaagcgcctttaaggagaagtttacactaggagatgacgttgggcgggggtttcattgtccaacgccaagcttaggaagtgatcactgacgctttctgtactgttttttgaaaaaaaaaaaaaaaaaaaaataagccattaggtgaggagcgttgtattgcttgcaagttgtgtgaagcgatttgccccgcgcaggccattaccattgaggctgagcctcgggaggatggatcgcgtcgcacgacccgttacgacatcgacatgacgaaatgtatctactgtggattctgtcaggaggcgtgtcccgtggatgcgattgtggaaggacccaactatgaatatgcgaccgagacccacgaggaactgctttacaataaggagaaattactggcgaacggagacaagtgggaggtggagttggcacgaaacttggaggcggatcatctctaccgttgaagaggggatgacaggaaataggatttacatttttttttctttttcttttgcggttgacgggccaagagctccaagagcagcgtatttctctgtaaccagaaaaaataaataatgaaagtcaagcaaagcacgtccagcgtattattcaagttgtgccttaagtgttatgtaccatcgacatcgtcaaaagaacgctagaggcgcgtcaatgcatttctttctgtcaaccgcttctcctgcctcacccgttcagacttcattcaagtagcatatatttctgtgcaactttttcgaatccctgttcacggctcccagtgggtgcgaatgggatggtgggtaccttttgatacttctttgaccttcactgaagggcttctaaaatgcacggtgccatccagctgaaggcccattgttgtattgttggggtatccttactgtggaaaggacttgcttcagggatataagctgtaggttgtgatatatcatcgaaacccagtgggaggaggaaaacgttattctacgctcatgaataaagcaaagccctctagcaatgcagggactgcaagtagggcctgaagtgtctgttatgcagtctatcattcatcgtcaaccgggctcgaagggcacacagggtgacatgactcaccttcggtccttgagagtgggacctgtgcacactcacggatcaattggtctggatgtctgtccagagcgtcaggaccactactccgcactttttgagccaatcatggtcccagcaagcaaggttgtctacgatcggtcccaagtgcctgccgtgtcggagcaccaagcttgaaaggtggtgtgggaaacaaaaacgataaggggactgctgatgaagtgtgcgggcgagacctcgaaaagtttcgtcgttttttttttttatatttgagccgggggtcgcacgttcgcttcttttctcatcactcgatccacccaccctccgattagaccaccatgacccagaagattggtaaggaaatcagatctactcgcccgttggtccgatcgaggcagccatggttgcattcattccgggacacatccgcttactccttgtctgatcgcgtcttgtagctattctttccgtctacgacaagaccggcttgatcgactttgccaaggagcttgtcgccctgaacgtccgcattcttgcttcgggtggcacctccaaagctatcgctgccgctggattgcccgtcgagtaagcctggtttcattgtggtttcttacagcgtcctcaggagagacgacacttacaggaggaagggtgaacgagattcgaggcgagcattcactcatcattccatgttgaaatactccttcactctactcttatagagatgtgtctgctatcaccaaggctcccgagatcttgggaggccgcgtcaagaccctccaccccgctgttcacggtggtatcttggcccgcgacatcccctcggacgaggccgatcttgctgctcaggctattgagaaggttgacatcgttgcctgcaacttgtaccccttcaaggagaccgttgctaaggagggagtcaccattcccgaggccgtagaggagattgacatcggtacgtttctctaactctgcggcgaaccttgatatcgtgattaccttcccagtcaaaaccgctcctaacgtctgttcgtggatgtaggtggtgttactctcctccgtgctgctgccaagaaccatatccgcgtcagcatcctctcggaccccaaggactacgccactgtgattgcccagctcaaggcgcacaacaaggtctcggacgagacccgtcagctccttgccctcaaggccttcaaccagacctcggagtacgacgaggccatctccaactacttgcgccagcagtatgcctccggcacccagcagctcaccctccgctacggagccaaccctcaccagaagccagcccaagtcttcatcaagaatgctgagctccccatcaagggtaagcagagaatgcgggcaaaaagagtgttgtcgaacactctgccgggctttgaatttgtttatcttttttttttcgtttcccttccctttaccccgctgttttccttttatggacggcaggatgctaatttctatgactcttctgtttacgtttccccactcagtgctctctggttcccccggctacatcaacttgttggatgccctgaacgcctggcccttggtcaaggagctcacccaggctctcggcctccccgccgctgcctcgttcaagcacgtctcgcccgctggtgctgccgttgctgtccctcttaccgatatcgagaagaaggtttaccacgtcgacgacctcaagctgcccctttcccccgttgctagtgcctacgcccgtgcccgtggtgccgatcgcatgagctccttcggtgactggatcgccatctccaccaccgttgacttggtcactgccaagatcatctctcgcgaggtctcggacggaatcattgctcccgcctatgatgctgatgcattggagctcttgagaaagaagaagggaggcaagtacacggtcttgcagatggaccccaactatgagccccaggagctcgagacccgccaggtgtacggactctccctccagcagaagcgcaacaatgtccagattgacgcttcgttgttcaagaacctggtcagcaagaacaaggacctgcccgagagcgccgttcgtgacctgattgtggccacgattgcgctcaagtatacccagtccaactcggtctgctatgccaagaacggaatggttgtcggactcggtgctggacagcagtcccgcatccactgcacccgtcttgccggtgacaaggccgacaactggtggttgcgccaccaccccaagatcttggcctttgacttcaagaaggagaccaagcgcgccgacaagtcgaacgccatcgatctctatatcctcgacaagatcggcaagggcgaggagcgtgctgcctgggaggctcagttcgagacagtgcccgcacctcttagcgccgaggagcgtgaggctcatatgcaccagttgaccgatgtggtcgtctcgtccgatgccttcttccccttcacggataacatccagagagctcatcagtccggcgtcaagtacattgctgcccctagcggatctatccaggacgatctcgtcgtcgctactgctgactcgcacaacatggtcgtggcccacaccaccctccgtcttttccaccactaaaaaaccaagacgaatcaccccctttatgtatatttcacctcgttctttttctcgacatgttctcatcgaagcacgcttatcattaaacagcttcatttctcagaatgcaatgtgtatgaaaaaaaaaacttggtatattcgaaaagtttacttgtactggacttggtcgactatattccagtagttggccatgtagaaatcccgtgtcgagatcgtcatttgaaactcggattgaagactcttatccttgacctttttatacatttcgcgctaaatgatatagacaaataacgtcctagtcaatcacaaatgaacaaaaaaaaaatcgtagtcgactgcttattcttctttctccttgcgcacttaccaatggataaatagcaatgccgacgacagagatgacacaaagggcctttgtccaggcgctcctcatgaacgtggccaggggcgatgcagattgcacgacgaccttattgttgaaaatagggtacgagatctcgatcgtgtatcggtaattcactgatcggatcgcttgcgtgattgcccttgtcagatcctcatagtcccagttgactctctacagcgttaaaagagatcaagacaggagaccaaatgtcagatgttggtatgtgcgtaagtttcgtctttttcctccgcagcgttgcattgcgatccttgacaagaaaaaaaaataacgataaatcattggcaagtcgttaccttctccatgtgcagctccttgaacggattttcttcttcgacatgctcctccatcacctcacgcaacgtcggtttgttgccagtctttgggtcgggcaaggtcaagatagtccctgcaggcgaaatgtatggcgtgaggtcgaagtccatcttgaaatcgttcaccttgaccttgtgctcgacagccgccgatgtgccgtccgagtgacgctcttccgtcctttgtttctccatatgagatcctaaataaaagtcatgcagataccgaaatgtcaggatgtcagtgatgctccatcactctgggaagaagaaaagaaagaaaaacgaaggccaccagcccatgcgccctgtacacaaaagtaataaatacaaccaaaaagaaagaaaaaactgcaatttaccggtgatcaggacatgcattgagggtcgatcgttatgtgcaacaaaaaacctatacaattgatatgggtcgtccagaagggcatcctgactttcgacacctcgcttagaccgtgtaaaagttgcgatggagatttcctgagcattcaacagagcaggtgcacttggaattcccgacagcggaaccggtggcgagtttgcagacatgccaaaaaattgcatcgttggaattgctggggcccctgctgccccttctgctgccactcccgttactcttgcctcactagagagtgcaccagcgtcggccgtggtaggtagcgaagggacaggtgcttgagacagcgagggctgtgggatagatgtggctgcgaatggcatggttgttggtgtcacaatcctcgcttccgtctgaccaaatctgaattcctttggcgatactgtaggcgatgttgagctgccagctcttctacgactctctaagggttcaggttccactcgcgttgttgcgaacgcaaactctggtggcggcggacttcgaggcgcttggggtagaagtggtggtggtggtggtggaggtggtggaggtggtggaggtggggggctggccggaaacaaagattctgaggccgaagggaatcctgggaacacaccgggtgggaaaccacctggcggtggggggccaaacatgcctggatgtccgaatccgccaggaccgtgaaatccagctgggccaagatgaccaaacggtgggtgaagtggcgctgcgtggagaaactgcggtggcagtggagcgccattcataaaaggaaacggtaagccctgcatgccgtctagatgttgagcgaaaggcatgcctgcggcggaccgtggattagaggcctctgtcgcgcgagctgcagatgcggaagaggcagggctttcagataaagcggggggtgcagaaggctctgcgcttggccgagaaaatcctggaggaaggtgctggtggtgaaggtggtgtccaggaccatgaccatgaccatgactgtgtccgtgtccatgtctgtggccgtgcaaaggatggtgcgcgtggtgctgattgtggtggtcaaagaggccctggcgctgatgaccaaagaagtttgcaggtccgtctgcagaactaaacgaactactagcgcccgctgctgaccccgagggatgcatgaacgtctgctgcgcgtgggtgtcgggtatctgaccagcttttaaggaagaagactcttgatatgcgcgctcgtcgtcgttgtcagcgtcagtgtcatcgctgtcgctgttttgaatctcatcattcaagttgtaggcctgtgtatggacattgctactgctgcctctgttgggtgcatctgagggctgcgtttggtgttgccgattcgtagcagagctgtcctcatcgatgtgacttatggcctcctcatacgaggggggaaaggactcgtcagggtccgattcgtcctgggagtggggctgcagcagctgatcctgggctggtccgtaggcgtcctgactcatcggaacgggtgagcagagatgaagatgcacagtggggtgcgctgggccaaagtgtgcgtgacgcgactcgactctgcaacgccaagactcgtgggcgctgctgctgctgctcagcctcatgtgccatacgcaccaaaaaggaaatctgagcggaccgatcgtcttctgacccgcacgacctttttccctcccactggtgctggatgggcggcttacaatcgcgtaatttcttgcgagcgagacctctccccaacgaaaaaaaaaaaaaaaaaaaaaaaatgcgacagtgaagcgcttttcttctcccctttccccctaaatggtgctttgtcctctccacctcgctctttcctcatcttggcttttggcaacctgctcactttcctgactttctggcgctccgaactctacttcatacatttctttcttgtacgccggtgaaaaggacacagccgacacgcgactcaggaattgcaataccaacttggcatgcgagcgggcttacaagcaccgctgacaacaaacaagagaactagcgataacattaacaacatcatgcaaacaacacacctgtgcgtcctcggcgccgtcgtcttcgccgcgctctccattggcgcctactacatctcaaaaaacgtgtccaagcttcgcgatcctcttccggtgtgggaaaccctcagtggcctggacttcatacccattcgaatgcgagcctggatgttctcagtcatgatcggtatcgccaatccgtattctcgatccatcaactttcggtttatcgaactgtccaagggcaaagcctgcggtgtcatgaaggtatgaaagaagagaaggaaaacaaccctccattgggcgaaagactacaaaaaaccaggcttcaaaagattcactcctcatgaggcttttgtgcgttgtaccttttcttttaggagaccaagcagatcagaaatccatttaggagcgtgcatgctggagcattgatcacctttggcgagaccgtgggcgcaatagcatttttcacactccttggcaaaaaggatcgtgccatactgacagacatccattgcgaggtaaggacagtaacgtccaaaactgaaaggccaatgagcaacttgacccctcatgtctctctccctttctgtcttcctgatatctttaattctggatcgattcatttagtacatcaaaaaggccaagggtgttttgacagcgacctcactcgttccggaattcaaggactcgcatgttgattcggttgtgacagaggtgataattaaggacggcacgtttgacacggtggccaagctgtcgttgacatggaagacagagctcaagggcgaataaaatacggagacatggttgcaagaatgcctgcacccatcgccgagatttatcgttgatactgaggctgggctacatacgacatgacttttcgggtgcgttttatttgggcgaatgaatcgatatgcttttatactttgcttgagatccaaatggcagctttacagccttgcttgatcgcattgctcagcaattcgtgttggggtgcctaaagccatggaggcaagaaagcacggtcgtgagagaactgcaatcatggcacctagacctaaacctgctaaaagaatcttccacgtaactcaccctctgtgcgccctgatcaattgccgtatccagatgctctaattcatcatcccgaaactgttgtacaacctaatgccatgatcatacaattcgtaacatgaataaaatttcattgtctcttgaaaccatttcaagacatgctaaaatacgacaacgtactttgcgcagctcggcaatatcagggtggtcaatcttgagcaattctcgcagctggctactcgaaagaaacatcatgcaaagtgtggtcaggacgtgttcagcaaggagaaaaaaaatcattcagtttttgctcgcgatagggactaaaaagctcatactcgttgtaatggcctccaatgacagtctcgacagcctcagtgcaagccatagccgcttctttgcccatcaacgctgtccctgcaccgagcgcgaaaccggccatttcccaaataggtctaagagccgtagggcgaacgcgatattggctcacgatcccatcaaagaccttcagatggtgtttctcttgatcccacatatgctgttaaaaaagtagcgcgaagtcgaccgaggcactatgttagttgacggaaatcaaagcatagtgcgcaaaggtaagtgttgatcagatacgtggatccttgtttacctgtagcaagggtccaaccttcttgtcggagccgaggacggcgtactggccgcgatagatccagttggccccgagttcaccagcttgatcaacccggatcatctcctcaagcacttcgcgctgttctttagagagtcgcagcggcggcactgtagctgaagacgaggagtctggagaagcctggctggtttcccctggagaaactgtttgtctttgtgtgattgaggtgccgaatgcgcggcgaaccgtgggaatgcgggcctgctgcgaaagcagggtccttctgagtgcagaagccatagcctgtgacagtaagtgtggaaaagagaaggtgaatgtacaagtggcagtgggtgtgaggatggtcgtgtggcagactgggtgaggtaggagttggacggaagacttagctgtgactgcaaaccaggtggaggataaatagttcctcgcctctgcagccctcaaggtttcctcctctttgaaatcaaacagattcttgtaaggacgaaagaatgggctcgcagttgaagacagtcaccaccatacagggacccagtggacagttgcatccaggaacccatccgtcctcgccgatcgatccatccatccacccatcgatccttttcaactgatcaacctatgggcaatcagaaaggcgccttctcgacatctggcgggatcagctgcaagtttgttgatgagccacattcctcatgctggccattggatctggtcttcttactcaccgttcggaagcagcactagctattatctcgcagcaatggtgttttcagagcagcaccttgcgttacttttttcacactaccctttcatcgccacactcgatgccgactttacaccaggaggaaaaactactcgcaacaatgcagggcaaagcggcgtagtcaacaacagcctgccgtagtcaacagcctgccgtagtcctctatgaaggcgccttgtaccatgctttccttcgacaggatcggcagacgggacactgcagaaactattctcattcggaatcttttgatctgaccacttttctctgtttcacaccccaaattcttcccccacagaaaatgaagtatctcgctgcttaccttttgctcaccatcggtggcaacaccgcccccgctgccaaggacgtctccgccctcctcgctaccgtcggtatcgaggccgaggctgagcgcatcgagtccttgattgcccagctcgctggcaaggacatcaacgaggtaaaaagcagctgctgtctagttacaacaacaaacgcgttcggtatatctagtttttcatcttgtacttattacccaccttccttcctttttttttctctcccgcaattgaatagctcatcgctgagggtacctccaagctcgcttccgtcccctccggtggtgccgctgctgcccccgctgccggtggtgccgctgccgccactgaggccaaggccgaggagaagaaggaggaggccaaggaggagtccgatgacgatatgggattcggtctcttcgattaaatacttgatcgccaactctcgatctttcataaacagcttgatcaaaatacattctagtaacggagggggacgctgtctcctttctcttattttgaacattcaaaaaaaacgtgcgatgcggtgttgtagtgaattctttctatatattacgtcgagctcaagcttcatatgaacctgagtgggcagggctggtgataagaggatggggtcaaacttgagggggaggaggggtgatccaggcatcctgcgggatattggcgcgctcctggtggacgagctttacaccgtttgcaatgtcccagttgacagccattagacactgaagcgaaaacgcggcatttagacccgtctgtctttgcagttcctgaaccatagcctgttgctcaggtacctatcaaaagaaaagcatgcatgctctctttagggcacgctgcggatcatattaatgaatatacgattacaatattggcaagagtccacttacaagtccttccaaaccggttgcgggtggttgaccaggtgcattttgtgccgagacatgtcctgcaatctgacttggtgctgtgagaacggcggccactggtgctggtcccgttgcaacgttcggtactacctcgggttgccatgccttgcttccattgtagtttcgaacggtcaactgatccgagataatgaggcacttccacccgttcatggcagcctgagagttggggggtgcaggtgcaatgatgaaagtccggtcgaacgacttgcgacccttggtagcgcctctgatctgctcatactctccgtgaacactgatgtaaatacagatggcagggagcaaggtgccagtttgccaggcgtcgacgcaaaccttggaggcatcgcttaaatcgtgcgctgtttcgggcaatgctagtaacccctgctggataatggcgttgttgccaacgtgaagcttttgcgtccgcgaggtcagatccttgtttcgtgtcatgttccggcttcccttgtagtcattccatgtgtcgccccgtttgttttgagacctttgaagcggagacatctcggcaacgaatgcatacgagaaggtcgcattgttgtcatacatgttgacgagtgcggctcggttggtatcaaataattgaaagtagctaacaatttgccaataaagtaatgaagaatttcgttgtttactacctcatgtcgcgacaaacaatcgccttcgttacatcaacatttgttaccttgtcaaaaattccaacaccatggcttgagtgccaggagagtcaaaaaagttgccttggatgggcttcggcagggaggaagatgacatcgagtcactggcgatgtcgcctagtccaaaagaaattttaggcgccactggaatctgatccagcacctgaagcgaagggaacatctttgtaatctgactcctgtatgcaaggtcgtccttgtttcttgcaatgtctctgtcgcgaagagggttgtccaagagaatgagctcccgcaggctggaaagcttctttccagccaaattctcgatgtccttgtaattttgaatgtcgttgcctttgagcgagaggttctggagctttggaaagtactgggcgacagcggaaataggttggagtgacttgagatgattggatgcaaaggaaatggttgtgatctataagataataaggaaaaaaattcaagttgaacatccaggatcttttacacgctctatcatcgaggttggcacgactcatcagcaacatgtccatccttacggctggaaaaagctccttggcaactttcatcatgacgggaccaacgtttgtgcggctcatcttcccgccaggtgggacaatggatgcagcacgcagggttgggtcggccgccatgttctctaaatccagaaatccattgttatgccttgattggatgaatgtccgaatggcatcaatcgtgcctgctgatttctgggaggttgaggtatttccagtagacgattgctgcgataggtccttgtccacggtggtcttgatcgttagctattcaagcagaatgagatgaaaatttagcgtgagcattctgatttagcgatacaagatactctgacagccttccgatatcctaccttttggccattgaacttgatccctgagagagccttcacagttcgtgcctgctgcatatccggcacgacgaaggacaccatacttccatcaatatttgattgttgctaaacatcacaaaggaaattgaataatgaaactttgtaaatgctgctgcatgtatactgcgaagtggactcgaagactgatacacgacaacttacgttggagatgctaagcttggcaggcgaggaacgcctgcgcagaaaatcgatcaaacgctcatcgtttccaatgcttgttccgctgacctacataaaaataaacgccgacaaagtaagaacaagggctgacatccaacaatatgtaagcagaatgagaccttaacaagcgcttacaaaaacgacaatcttgtttccatcgttggagctggacggtgctgacgattcggcccggttgtttcttccaggtcgctggtatggagagctggtgtatttatgaatgataacagcaaagccgttgagataaaagtcgagtccgtgaggcaagaagagaagaacaggaggaggtcgtcaatatgcattcatgcattcaacatgaaaattggtggcacgtccgcagtgattggccatctgctgcgcctgcgtatcgtaccactgacaaacaacgcacagactgggtgtgcggacaccaaagtcgatccacattcagcagcaaagttgacaacaaacagagcagcttcgattcctcatgaagagcaggtggtatattgacagttctacataaacaagtgaatatagtgagcgtaacttacaagttttttttcttttcaccgcccatgtccatgtctccatcggtgtcttcccttccaagagatcgggcctgaggcaggtatgccgaagtaccgcgaggagcacccgggcgtcgcccacctctgcgccctccatcacggacgggccctcctcccctgctggcgcctctgcctccgcctctccctccacctccagaattgcccgtgaggcgatcgcggcccgcggcagtgaagaggccggaggcctcatcacctgtaactctgtccctgccccgctgcatggtctccttttaagtttgttcgattgcgtcaagcgccttattttggcagtggatcgtcctgcaaggccaaaggataggaattgtggatgcaaatgtcaaaggtagagagggacatgtgtcaatgtgaacacagcgctctttttttataaagtgtgtggcttggatgttttttcagtgcgccaccaatactttagtgggcggtacttgagactgtataaaaaatgcacttttattacgcggctgtcgtcaatggcgcgttacggggaacgttttctctttgatccttgagtacagtccaatatcctcatggcagttgggacatgagtgcatcatgtctttacaagaggttaagcacaagggcagaaggcagcatccacaagaagtgattccagccagcaatagaccaagaacgccaagatatgtacaggagcctagatccaagagtaacttggttaataatagtcatttgccaaggcaccacattcattcgtacgaccatgtcagtcacataccattttcaggcgtagtttcggtcaaaacaagataatgacaatgttgacaaacaacaacgccgggcttggctttcaaatcctcgattctgccaggaggcctcattaggaccagaggcgaggccatgcagtgaccctgctgctggtgaccaggaggtacacatgttgcttgctggggtggcggctttgaggtgtcgttgaactttgggtgttggtgtgtgggctggtaaggcagctgctgaggtggactgtaaatttggggataaagccctgatgggactgcagaggagggccctgcaacagaaggcgcctggtgggcatcgatgaacggtgacgacggagcagtggagggtgtgtatggtggaggctggaacccttgcgacagaagagagttctgtgcagggtcttcgtctgctgtggggaccgcgctgtaatgacctttcttgtcggacatggctgtatgtgggattaaaagagagagagagaaagggagagagtgaggtgtggctgttctggaggatcgcaactgtgaagtactgatggagtgtagaatggcgtggagaacggtgatgcctgcctttttatgccatgaagtcttggcatacggtcgaccgtagtggcttgggcttggcaattctgaattctggatcaggccgaaaaaaaaaaagaaagaaaaaaaaaagaaaaaaacgctgtgcgcaccgcaacgcggctttcgtcgttgtaggatttttggacactctgttttcatagttgagacgcctctccacctcggtgccactagagagccgttgggacacctttgtggagtggcaagagccccggggttggtctttcatgagagcacgggctggaggcctgcaaagtcactgagggtctccacaccatccaggaaacaatgacatcggtggcacgaacttaaatgtagtagtgtgtgagcccgcggtggtcttctttaatccgaacttgcgacgcctggaggtgcaacatgtgtgtggacaaagaatggtggagaaacttgcccctttccttatattcggcaactgtgctagcgaccatctgcaagctgaaagacatcatttagtctatcaaaggctaaactgcaaactgcgcggctagcagttttgactgtgccttttgcatgttttttccggcactttacatttctggccaacgaccaccagcgacgcctatctcatgagctgagggacagctgtagttggctgcgctagtagcagcttttttgttggttcgaatagcagctgcaaggtagcctggagagcagtgagagcaccttgcaagtcgccatgaagcctgctgtaaaacaatggatatggatatggatgcgcggaactttgcgtactgtacacacccccgttcggagccaagactgttgagacatggcgcaaaagtgtctccattcgccgctacatccccgttgtcgtgctgtaatcgcgcctcgtgagtatgtcacacaaagtatggggctgcagtctcaggcatggcggtttctgtcagtctgtcggcggtgacttgttgagcgttatggtttggagggtcaggacggagacgcacagaggtgaaccctcgctggatggtctgatggatgggaaccttctgcagttttttttttcagcgtccgttctatttcaagcgtcaaagcccaaccatggtcttcaaaacttctctagcctgccgtctggctgtgccggctgcactgtatataaagaaaacgacttcccgccctgcgcctgtctcttttccctttgagcactcctcttccctccctccaccctccctccaccctccctctcgccgctcgtttgcgtccctacactctgacaatccttttgtccttttaacgaacccattctctgcagcgtccacagcagcccttgctcctccctccgcctatcctctctgctatatctcacatccctctcctccgtcatcacatctcctttccacatcccccctggtaacctgcttcgacaaatcgacaggtgtgcttcctctctcagcaatttatccccttttcctttccttttcgtttgtgcctcgccccgccccttctctctgcgctcataacaaagttctagccctcccttctccacgacccataaatctaaaacaccgaagcgaaccccccactcccgcacacctgcatccacacacaaaaccttggatttgcgcccatctccattaagcgtctcgaccctctcggttctactcacacgaccaaaagtctaatcaagcaggtgtgaaccggtacctggctcgcacgttcgtcccttttcctctttactctcattttacctttcccacatccttttgcactctcctcttatccatccacttcatcatacatcgctttgtcccaccatcattcctgtccacttcttcctctctcaccacctccactgtgacacgcacacactttctttttattcgtccacacgttttcatcgatcgataaaactcaaaaaatcaacatgcggcatcctcaaaggtcactcctagcagtgagctccactctttttttcacactggtactgctcacgcaccaggcttcattcagccaggcaagagccatcgctacctacgacagtagcaacaacaatggcaatagctactcgctccactggaagcgcgaaagccacggccattccccgtacacgaacccggccataacgccaggtggtgctcttcaaggagacgatgaaccatccagcaacaccggtggaaccgcaggtcctactcgcaagcggagtttgttatctgtcgacgaaaatatcagggctcaggatgcagacagggcgaaagtattacacagcgcctttcagcaaaccagacggccattccagcgccgactaccaacagaaacatctgaggaacccgaacctcagtatgtgaacgtagatctttgggaggaatctgacgatgatgaggtgcgcaccttgatcgagccccagtacccatcgctcgatttgtttgatgaagaggacgaggagttgtttgatattagtgaggatgacacagtggttgagatcggcaacaagaagacggcagatgggagctcggataatttgacatatatggtggatgagtgggaggaggagctcgagaccgatatggatgagctgatggactgggtcgaagacgaccacatcttgagccggcacggccaagaacgcaagaagaatgagaaggccacaagactgcaagcaccggcgccggcgtcggggtctgctgccgaagtgatgggctcacaccgccttcgggaccaggcatccgtccgggatgtgcttgtcgacgaagatgaggccagcccgtttcaacgaatcttttccgaatcctggcttttctaattgattcgtgcacggctcactatctctccatctctcaattatttttcctttcctccgctttttcatccccttatgcggttttatcttgagcttgcaatgttgtcaacacactccttcgttgccacgttgtagctcggcttgtaaatatcacattcttcctcaaagttctcgaactcgttgtggtcttttgtatacccttttccactcgagcactgattatcaacttcccgccttctcttgtactctcctctccctttcctcctgtgctccccatcctccctctctgatacacccaacatcccctctctcttctttcacatttttcatgactcgactttccagttcctttggctcggctgctgaaaaagttcatgtattcgaataaagtgatgtgcgcgcccagtatggtttcaaagatgtgatgattgcataagcatcacatgtggcttctcagagcccttccacagggcgcgttggtcttgacagtgccaccggccacagtaaaaactctgattgatgcagttgcggcacccgttgagcgacgcgttatggtcccggtcgagttcaaaatgacagccgttacaccacatctttctgttcctcacagtcatctcctcgtcgcagcatgcgatcgtgagaccgagtccttcgacctaacaacatcaatggtataaatacgtgtctgctactttcagctctctggatccctatcaaggatgctgccgttttttctcatctttctcttaaactgctggtgtccgacctttttatcaaaaggtgctatctccaatgacaaatacgggacgaggagagtcgtcgtcggtggtcctttggtgttttgtacctgagtcgcacttccattcttccgtatgcgataattaagagtatccgtgactagggcctgaaaagctatagatgtcctgatggttcctgtccaaaatcactctcttgttaccgttaccttcgttgacccaatcagtttattaagtttacccctagagcatatcacaggttctaatgccggttgtcgagataacacggtccagggctctgttgtttatagcgccatcggcttgtttccgatgaaaggctttaatcttgtatgtccgattgctgtagaaggctcggagcctcccttggaccggcaatatcaaaggatgtggctctgaactgactgccgcaggtggtgccaagtgtcggcgtgggttcctgcgtggccatgtggacactgcacgccctgtatctgctgttcccaaaatctttaatgacagacatttaccgtgacaaagcaatgaagatatatctttattccatcctttgatcgtggtgcttcagctcctcttctgtcaggacgatgccaaaatactctgctaaggcatccacgcgatcctgctccttctcaaacacaatcgtcttctctgttcctgttgcgttccggatcttgagttcgttacccatgagcaccagatatttgccatccaacgttccctgcacgcaccagaacgccttaaagaaaaccgaactgggcgaatggcaagaataaaagtttccgagttcacaatccttatcgtagaactgctgctccgtaaatgcatagcagggtccccacttgtcgtcacccaggtactcctccatacaccacatctccataggagggttgcccagcagctcgggctgtgccaaattatgaaccgtcttgaccatgcgacgcttgtgtccaaagtattcgacgacggcgccctccttcaagggcaaagggcgcatggaggtgttgccaaagccaatatcaaacacgtatttggagccatcctcaaaccgaacgatactgacgcgatgagtctttgcggtgtagacgatagggtcgccgtaatgcgctggcttgcagacccgggccaatgtgaactgggtggtgtagcctaggctgcgcaggagctcaaaggcgagctggttgagggagaagcaccatcctccacggtggttagtaacaacccgatcgtagatgccctgtaacgagatgtctacttcccgcttctctgtcaggcgcaagctgagcgtttcaaaggggatggaggtgacacagcggtattggagttctcgaagcgtctccagagtgggctcaggaaagacgtctggttgggcgagaggaaactggatgcgacggaggataccaaagacctggtcgcgggtgaggtgctcgactgcgccgatggacatgtttgatggattgactggtgccgttgggtatgataggtggaggagagggaaaagggctacacacgaaggtcgctatgctggggtggtttgttctgttgatgaatgagatgagatgaggggcgccgagagaaaatggatgcgcttttataaacgaggaacctgttcaagtagaaaggtcaacacgccgcattgacaaatcgactcttcgtgctgtggcgcgtgtggctggatccgcagtttccattgactggcgggcgaggtcgattcaggaacgagtgatccgcattcctgttctgactgctctgtgatctgtaccctgggcgcactttggtcggagattggggaattttctctccattcaagtctcattctgtaaaccgtctacatgcacaaagtactttactgcaagggtataccatcctcgtccctgtcctcttcctcctccttctctgctgcaccttctcaagggtcttctccagcggctattatggacattccgttctgcgtcctgcgcacctgcgtagcacagacacaaggcctaattgccgttagagttccgttgctgcgcactctcgccgagattctcgccgcctatgcgtacgcgtatgcagcagcagcaagaaccaatcctagcctcagacgtgtcgttgaccatcggaataccattgttcgtcctcaactctacttcagttgactgcaatgtagtatacatgtatggcgaggctatcattagaattggtttttgacatccgataccacttttttgggtactgtacgcaagaaaagcctatcattgatgcagtccgtcagttctgactaagcactttgggcgccggtgtccttatgccgaccgaaagatcagctgacacctaaattttgggtgtccttaaggacgccgcgatcattccagatctggcaatttctgtgcgcttcgcactcaacacgctgttgacgagattcacacaacttcctcctcaattacgcaactatacaaagcaacaaatgcctgcaccagatcaccaggaatcaacttcaggcacagacagtaaagcgtccactttgcctccaggcatggtacttggacccgacggaaagccctgtcgcacctgtacggactggaaaacctggtccaaaattggaaaggcgaaagccaagaaggactctaaggagacgacctcgtcaccctcaacttcggcatcaggagcagcaggagcagcctcggttgtcgctggatccaccccaggcacatcagccgcatccacattcaactatgaaaacgaatgcccgcctgataaggagattcttggacgcgctacatggacgttcttgcatactatggccgcctactacccggaaaagccctcggccatggagcagacgaccatgaagtctctgctcagctcgttttctcagttttacccgtgtggaccatgcgcagagcacttgagagaggagatgaaggtggatccacccaaagtcgagagccgcaaggagttggcgtggtggatgtgtggaatgcacaacaaagtaaacgatatccttggcaaggagccatttgattgcaacaaggttgatgagcgatggaaggatggacccgcagacggaagatgcgattaaggcatggagcacaagcatacctggcattacatatttacgcacatcatcatagagaacataaagctttggaacatgaaagcacctgcatacacattctcgtccaactgcagtggttgatatggagattttcttcctttatctatgttaaattcaaaatgctaattcaattgcttcacactataacatccagtgcgccctatcccgcgcacagtgcgggagcgagtcctttactcctgtctccatcctgatatacatatcgcaattaaacaatgacgggcgtatctccaactttggatggggtgtacgttgctccctcgatctcaacattcgaaggcaattcaaagtccttctgctcctcaaggtagtacttagtgagggcgtccttgttcgccctgaactcggccatcttgagcgacgatccgaatccttcacccaacttttccgtaccagagtacacgccgacaataaagactggtgccttggactgacgacctgtctcagacatgagacgggccacgggtctctcccgctcaagacgtttcatcaataccgagagatatctcttgggctcctcgatgtcgagcataggagccaagtccagttcacgagagaggaaatgtgcgtgaacaaagtcgcgggccttaactgctcccaagtccgtgtaaagcgcgccaacgactgcacggacaacagatgccttgactgtctttgaagtcaactgttgagcggcatcaggctgtcgattattatcgattgaaaaagaggaaactcgccgaattaagagctgtcatcaaagctttcaactgcctgcaactttgaatcctgcgagtctttcgtaccttggatctaacccagcgagcaacatcctcgacaccgaattccttgcccatgagcgacaaagtgtctgttcttgtgtaggtcgcaacaacatcctgcagcatcttggtgggcatctttgggtatttggtgtggaggtactcgagcacaaacattttcaagaccttggcacctattttgaacgttcaaagagaaggaaatgccctgatcagcttctgcacatctgttgcagccgccatatgataagttgacccgatgatccgtcatgatctgtctccactgagcaaagacttcatggtggtgaataggcgactgcttaccaagataatcgagcttctcattggtctggattccaactctctcgtaactaccgtgggtgacaatgcgcatcaccaacgtctggtccttgagctggtccaggcccaatcgatgagcaaatgccacaactgctgctgagggttgttctatcctgtattttgagtcctgagcaagtggtgatgaaccagcactagttgtgttcttatcctcatcgtcgtccttcaccagttttgactttttcacgggtttgacattgatgaggaacgttcgggcgagtgtaggagcacatgctaaaacagagtggaaaataaaaagctgatcaggcactgtcgacgtttcttggtgcatgagaggcactacggccgcttctggaagagatgcccagtccagtatgctctgcaaaagtgcagagtctagttgttcctgaaactaacctcggacagcagaggcacgaatgctggtcctagcaaggacaaggggtgagcgaagaagtccggccattctggtctagtcgtctgttgtatggggggagggtcagggtgcgttgccgggccacagagtgtagaatgcagcaaggcgtgtttgtttgttgcttttccggtgcggcacgagagagagaacaaagagtaataacggttcggaagtaaggagttctgaccagagtggcacgttgaatggcgcttcgtttgcaggtgaactcgtctggttccgcttcaaagggtaaacaactcgcgcaaagccacaggcccagagcttggcacggaagtacagggaaatctcaaaagtcaaaaataaaaaaagcgagatctcgtggaaataaggccctgtctaaatatggcgcgagggagctttccacccagcgtttccgctctcgcaaaaactctttcctcatcaaacaatccaacacccatgaaactcaatcccctccagaatcaagtcggtggtcacgacggcgtactctcgatgggtgacgataacgagattattgtgaagccctccttgcctcaggagcaccagttttacgaggaagcagtccttcaccctgagctccaggcttggatgcccgagtactacggcagtctcaccttgacgcgccagcagcccgagcagcagtcaaaagatggtgctgagaacccacagtccgctcctacgatcaaagcaatgaatggcttcgtgctcgaggatctcatgtcctcgaccgatcgtcaactttcctcggagggttcgacttcctccgcgggattgatccagcaggccgtcgaaggaattcagggagtaggaaacgctgccgtggagggttcggctgatgcaaaagatgccgaatgcttatgcctcgagaatatctcccatggattcacaaagccttgtatcctcgacctgaagcttggcacgcagctttatgacgataacgcatccgaagaaaagaaggctcgcctaagcgctgtatcggccaacacaaccagtgaaaagtttggtcttcgtctgacaggattccaagtatgcacccctttttttcgtgttaattcctgtcaatctgcagatagcgcactgaccgttgtgccacaaaccccaatattaggtgtatgacagtaccaaggacaactttacaaagtattcaaagcactatggcaagggtctgaacgaggacactgtcctcgacggtttcagggcctactttgccgctaatctgggtccccagaggatgcgccttgtcgttgagcgattcgtgaacgacctgaccgactttttgtctacgatcgagactttggaggtcaggatgcgatccagttcgcttttgatgctctacgagggcgatgtagaagccttcgatatgggtctgcggttggagcaggaaaagattgcagctgtagttgcaagggccaaggcttattatgagagagaaggtcgcgagcgtaaagaaggaggtggcaatgaagaagaggaagattcggactcagatgacgacgacgatgatgaagaggtcgcacaaaaagtcacggacatgcggcttatcgactttgcacactccacctggactcctggcatgggccctgatacgggtgtcgtacttggtgttaagagcgcgctggcgtttttcgaaaaacttttgcaggattatcctagcgaggaatagacgatcattgacacttccaatcaccatcatcataaatccccatttttattttccttttgatttgctgcgatccttcacctcatctagctgatctgtcttcagcttcagttctttgcggagattctcaagaatcgagccgaatcgtcgctgtaaaacataggcaaagtgagatgtttagtatgcaacgcgactttgaggtgcagataatcttttgacgtataccaaaatatgaaatgattagaaaatacctttaggatatcgttcggtgctgactgaaccttttcttcattgtctcggacctttccattgagctcccgaatttcgtccttcaacaatttttccagttgagccctttccttgtcttcttcttcttcttcctcatcctcgtcctcggatccactatcgtcatcgtcgtcatcctcctcttcatcctcctcctcatcatcctcctcctcgtcatcatctgctcctcgcttgtcactgccggctgcagtcctgtcttccgaggtgctagcagatggcatagccacgacaccggcagacaccgtgatgtctgttgccatgcctaggtctgatgcagccactcctgctgtcctgacttctgtgctgaacggcccaatgttcgccggttgccctgcggcggcgttgctgttgttttgacgctgcggcgtgcctgcgtcgtcaccttcctcgtctgttgcattttctccgccttcgataccaatctccctttcaatctctgcaaagagatcctcgtcatattgctcgtcctcttcctcgtcctcatccccttcgccttccatttccatgtccatgtcactgtgcgccccttcaggtgctggtgtagccccatcatccgaatcgaatctgtccatgccatcaatttgttctctgatttcgtacacaacctcctcagcctgagcatcttcctgaagcagtcgttcaatctcgttttcgactccttcaacagcctaaaaagtacaccggcgaattgttagtttcgagagatacagagttgagaacaatgcttcgtaacaccgggtcactgaaagtacatcataccactttggaaactctttttctaaatcgccgtttccgcacgtttttgagtggattcgtcaagccatcaggccagatgtactcgctcggcttcaggggtggtagtgtcggtgcaggcattgagtttcttgaatcgccattcgccgccggctcggacttaacgtgcgtattactctccaccggtaccggatcgacgagtaacatctgtgaaatatccgcaatcttgtacatctgcttcccgtttagagtcttttgggcttcgataatggttggcaggtcgactagttttgttgcgaaattaaggccttcaaatgtgaaggttcctctccttgcatctacgttgaaaagcaaataagtaagacgcagtaaacatttgcattgacacaaagcacctgagtaaacaagtttcttacctgtaaagcgcagcttgacagactcatcgacttcgcgcgcaaccaccttctcccggaagcgatcgcacatctctcctggcggcagtctcaagatgaactgctcctcgatgctgacctcaggttcgtcctcattgtcatcgtccgaatcctttcctccaccaccagcgccttcgtcgtcctccccggcactgcctcctccaccgccacttccagatgcaccgcctgatcgccctccacgtcctccacctcgtccaccacgcctgcctgttccggcgccagcgccgccctttttatatgttcccttttgacgacctgatttacttgataatgctgcaccggcagccgcccctgctgcagcagctgcggccagttgtttacgtggcgctgttcctacaggtgggctagttattggtagcggtgccacgggctgtgatgaggttgcgaaggcagccgcatagcttcctccagacaggtctgtcctgggcgctattgacatgccagctcctgctgagcttgggaaggttgaattcgttccagtggttgtagacggtgcacttccagcagccgcagcagatcctgagagggtcccaatgggctgtgggtataaattgggattgaatccagctcccgggctcgacattagtgatttagtgtggttggtccagacgaagcgatgcaacaagcaggaaattgtttggcctgggagttcgaagcgggagtagcggctaaacacgtgatttattctcgagtaacgcgttcgtttatgcgtaatattgaaggctagtcttcttcttggcctgcacttcggcgatacccatcaagaaatcgtcatggttcaactgattgccaccacgacgcaaggccaacatgccggcctcaacgcaaatagccttgcactgtgctccgttgaactcgtcacaactgcgggccagttctgcccagttgacgtcctcagatacgttcatctttcggctgtgaatctggagaatctgcgcgcgtgcctcttcattgggagtggggaactcgatcttacggtccaaacgtcctgatcgaagcaaggctgggtcgaggatatcgatacgatttgtggcagcaatgacctattgcatttgagagggcagtcagttatcatgcatcatccgagacgttatgatagagtatttaaaaaattgcatgatggttcctacaattttgtcgtaccttaataccatcgtcactgctgaaaccatcgagctgattcaggagctccagcatggttcgctgaacctcacgatctccggtcttttcagaatcaaaacgcttcgttccaatggcatccaactcgtcgatgaagataatggttggcttcttggccttggccaactcaaatgcatccctgaccattttggctccatctccaatgaacatctgcaccagcgatgttgctgcgagtttgaggtatgtggcgttcgtttgggctgcgcaggcacgggccagcagtgtctttcctgttccaggaggtccatacatcaacacgcccttgggaggcttgattcccaagttcttgaacctctctgcgtgagtcatgggcaacacaatagcctcgacgagttcttcaatctgcttatccagtcctccaatatcgttatagtgctctgttggtttctcgtcgacctccatggccttaacacgggaatcatatctatcgagtagagatgatgcaaaaagtttagaaacgtctcaatgacaccagcgacagcatctcgcagagaatttcacttgtcttactccgtaggaagggtgtccagaatcaagaaactgtccttgttcactccgatgagatcaccgggcttcaatgtggcagggtccactaatccgatcagcggcaagaagatggtctacagataggtggtctaggtaagcttacaccgttctcaagttccccgacattttgtggttgcatcaaaccccgtacctgtctggttgatgtcttgatcacggcacatttgcctttcctattagcgtccaggtccattgctgcgccgtcttcatcttcctcatcctctgggtcaatatcgagcagctatatgcgatcacgttcagaaacgtagacaaaaaatcaattagcttgacgatctgatcaagcagggcctcgagggcgaacgtggtcgaccagacgtcgctgcgcttcttacctcaacaacgtttccaacgaggtaaggaagttgtttgttcatcttgatcttttccttgttgtccttgattctctccttcatcgccgcttgttcgtattgcagacgcttgttctcacttttcatgacctaacaataacgagggcacacaatgtcgcgttactgacgagtcccaaagcgtcgcagcaaagtgcgagctcctgaaccagcacagctcgaatcaaaagtttctgcttcctcaccttgatgtcattgtccaaaagtcgtgtcctgttaataatttcctccgtgttcgcctttaagatgtctgcacccaaaacctcctcctctggggttgtctcccaaatcgatttatcttccaacgtggtcattgtccaatggctctttgctgtaagctatctgtgggtctgtggtgcgtgtattcgttgtctttgctgtgatgaactgtctgacgaagaggaagtgcgagtgatggaaacaatcgagttgaatgcgcacgcgttcattcgaattacgcaggcgtcccacgattgatcacgtgaatcgacgtcactctctcacacattatatatcacgtgatgtcgaaccggatgtgagtctagcgtaaaaagggagagctcgacaccatgcgacgcaccaaaaaaaaaaaaaagacaccatgcgacgcagattcaaattcgaattaaactttgacgatcaaaaaaaaaaaagacttcatgcgacgcagaaagtgcaccatatgcactcagcgtgttaatcagtgtagtgccagttgtttggcagtagggagccatagaaggaacaagctgtttaattgcacaagtagttggcacgcctgcacgtctggtggatctggcgtcaataaaagaaatctgagggagcacgcagggctgccccccgctttctcatcatgtggagcactgagtcgcgcgattgacgttcagcacgccattttcgaggaaattgattcaatttgcatctgcgttctgtttcgatctgaagacacgtcgtgtaaccatgaagaaaactctattttctgccatcgatttctcgcaaatgttgcagcaggcatcacttgaatagacggcaaacgatatgctgccaaagaaaaaaggtactgtactggagacaggttgaatcgcaaggatgcctatgattcaaaacaagatgcaacagcaaaaaaaaaaaaaacaggcatctacaggaaggagtgaatcgcaagataagcagcagaaacgacgaaacacagcgtgcacaccacgaactgtatagacatgtacatactgcacgatcgtgtatgtaggcgcttgtccgccagcgataagactcagctggccatgtgaggatgaccgagtgtggttagaatggcactagcagaggttatgggccgaatcactggcgaggggggtccgcgtatcagcaacgtgcaaatacacagcatgttgtacctgcgaaaaaaacggatttgatcggcggggacgaacacgaagggcgtgatggaggaatgagggatgaggtccaaacacagtttggttgacccaaacacagtttggcacaaaagaaaacaataatgcaaggcagccagggtaactgtcgtaccggacgcctcgctgtttgtccgaccaaatgaaaaagtgcaattgaatcgctcactctcgactcaatctcttgcctgcatcagtgtattagtaatgctgcactcgtgaatccacaggaggataatgcgagaatgcgaaagaagaagcccgttggtaactagggatagacaatccgacgaccagtgacaccacacctcaccatattctccgttgtgcagctcttcgacgatgtatggccctcgcgacggctccggctccctgtcgcatgcgagctgatcctttccaaaacaaattatcaagtttgaaagaccagtgaacaggcacaaggcacatagcgcatgttcggattcaacgtggtatgatcattgctcccagagagaggcagcagattgttctttgcgcattctgtgcggggttcctggcttgatgggcaatatggcgaggacatgcaagtccaaactgtgttttgacgctcttgatccactcattcgctgttctgcttagattacgctctttttttcgcgcattcaattcaacctgtttactctgcgttgtatcctccaccatgtgttctcgtcccctctacttttggacaactctattcacaagaccgcccaatccgaacttggtccttcttactttatgatttcttcgcgggatgtattgtctgaagagagtccgtcttcgctccttatggacagcttacctgcgacaggctatgcagtgggccagcagtgaattgtaaagggtcccctgtttgaagccgtgcaaacaaattgacaaagatccaatgaatatcgtgtcatccagaagcgatgcccgccaatacaaatcctcctttcttctcgcttgccttcctccttcaccctttctatcaccgtccccgccttgcagcaacttatgcgcgtttagtctttgagtactgcactcacccactcccgcctcactcgaagccccattaagtctctgtgaatacaaaaggacagcgtcttataagcgcgcactttctttttcaatcctgtcgtcccctttctccactaacttttcttccactcctctgctttgttgccctactttcccattcttttcccttcgtccttggcactaatccttcaacttctgctcctcctcctcctcctcctccttgtcctctgcttttgactgatcatcgttatagagatatctctttgccgtcaccgctgccaccaacgcacacatcttcaccgcgcctacctccttccctttcatatttcttcagcagtcttatacccatacatattctaatcgacttcgctttgcaaagtccacaacacagcactacgcaccactttacaatatcaccgataactcaaagctttcggtccatcaccctatctaatcagcctaaagttataacacctttccatacctcgtcatggacagctatcccaacccttatgcagcgcttatcgctacgttcaatcaagtatcgccaccagagtccaacgatgatatggatgatcctcaacacctacctgatgacgacctgttactttgggccaacgctcaattcacgtacgatattcccccgggtgtgggtatttacgaggatgagatgggggtcaaattggctatgagccagcagcagttccagcaaacgcagctgcagcagcctcataaccagcaacagctgcagctgccacagtcatcgcaaccacagcaaccatcgttccagcatcaacagcaactgcagtctcgtggcaacgtcaactctcaacaccagcagcagcaactccaaccccatcaccaatatcaagcctctgacatacagcagcaactacatcactttgatgctattcatcggtatctcgaaagcagttccgaaggtaataaattagcaaggattgtcgatacgcttttaaattcccgtcgttactaatgcctcgccctcgccctcaccctctttcgtattaacacactttatcagattcaagagtccccctctctctgcttgagaggtcaagacagcgcaatcccgtcagtggcggctccacctctgcaggtccatcccagcagcctgcgcactatgacccacgactgggcgcaattttcccacaaactagtgctcctgaatcatcgtccttctctgccgctacaacctcaatccccatcagtcctgccgcggcccggctcctgcgccagccgctcttagccctggagccacatcacccgcactcgtatcctggctattcatccggaacgacgacgccgttgatgtctccgacaactatgagtgatttccaccaactgcagatcaacccacatccgtccgtggccccgacgtccactgccagctcacaagaaaagagagccactgcccgaaaggatagctctgcaaaattagcatcaacgaaaatcaagcccaagtcttcgagcgcttccaaggcaaatcagctgacacccgaggaggatgaactgaaccaactcgaggccgagcttgaggaatatgagcaagagctggaggagaaccgacaggcacagcgcaaaggagcatcgtcccccagctccgattccaggatgtctactcttgagaacgatgacaactttaacgaggatcccgaccaaggggctaaattgaccgcagaagaagacaagcgtcgccgtaatactgcagcgtccgcccggttcagacataagaagcggctgcgtgagcagattcttgaaaagacggccaaggagatgaccgcaaagtccgagttgctcgaggttcgggtgcgagagctggagatggaaatcaagtggttgcgagggcttattgtcgagaaagactcaagaatgttggatgtcagtacaccgttctcgactgcggctgcattagccacgtctgctctgtcagggacattaaccttatcaagtccattactctcaggggacagtgtcaagtctgagaacgcttcaggatctaaagcaacggttaaaaagcgaggtaggaaggctcaagtgtaggcttccaacgtgcattaaaaaaaaaaaaaaaaaaaaaaaaaaaaagaaaacctctatgcgagtccgggaaaagtccactaggtgaaccctttacggtatagctcatgcttctctctcgaggcaattgctttacgacaggcattggcactttatcactctctacgctacgaaagcagttgttcggtaactcaaagcttgaaaaatctttttcagatgagtagaacaccttggcgacctagaaagctgtacacacgtgtagacagcttaagcgtccgtatagcttataactgtcatatatttgcttatgtcttttactttctggttgttactcctacttttttgaccgctatcaggccgttgaacgcgagtattttttgaattcttcgagttctttgtagccccaagatctattgagagcatcgaaagagccctttgcagtatccataatttttctacaaaagagaacgattctcaaccaatgggagatattgcagcccaagaatgaaggagacaaatacaaaattaagctgcttacacagcagccatacatagggacaagaatcgccgcctcatcatcttttcggtcctctaagcaaagctacaaaaaaaaaaagatatcaggaccttggtttagtagccatcatcaaaaatgaacgagaaccaggtccatgcaactgacgcgcgtaccttgatacctttcattgccaaactgtcgttaaacttacagtagtagagtctcactctgtctgacctcactcgatttgatgaacttgtagtgttttacgctgctatggggctcaggtgtgtatgtatctgagtcgcacctccctttttacttctacgattactaagagtgcccgcgaccgggacctgaagggctataaatgccttgctttccggtggtacatatatgcgtaatctcctcgatttgtgatggaaacattgctcggccatctgcatcgatagtcgttggttgttcatctataaagatactgttagaaacgttttcctggagcgctagtcacgattcgatttgtgtggacggtggtgagtccgtctgtagtcgctgatgacggagctgagttcgagtaggtaatgggtcccagtgtgccggattgaccgtcctagcatagacatacccttaatattttagttagcgaagattagtgtggacgtgtcctttgatgcccacgtccacaggagacattgaatacatctttcttcactccgttctcgttactcatagctcccagtaacagtgtctattcctctaaccgcgacacccaggtctcttactcaaggtctccattctagtgattttctcgggacagcagccgaagcgttcggcctagccgctgaccctgtaatagtgctctagtggctgtggggaagtccacatgtttgaaccctgagccatctctagggcaaattctctcggccacgtagccttgctttttgaggaaagggaaagcgcatttgaccctcgtggcctacaattaattttcgtaccagtgttggcgatacaagggtgagctaacgacgctggtgtagtgttcagaggcctatttttttcaaaaatcattgttggatacggtcgccaacagagctgtatgttgctcggtgggtaatcccaatgtcttcagcgtggctgcttcatatattttccatagccctgacaacttggttggaggacggaggagagccacattgtatgctctcgaaacaatgcaggtcgctatcagccgatacgatcacagaccctatttaatctgatgccagtccagcaatgcacaggtacgattcaaaagtgcaacggcaaaagttgacccttgagatcacaccatccgggacagcggctatacaccaagaatgacggacattctcttgaggcagagagtaaaagcactaactaggaaagcaacgaaaagacaaagaactgggagagctcaaggtgttcgaggcaagagagaaaagagagaatcagcgtggacaagcgccaacgttgattaaaactgatccggcactgtaccaaacctaggcagtcctaggacttctcctgccaaaagcggtcctacttaagggcactgcttcattttgtaaacaaaattttggcacatgatgaaggcgactggtcactcaggcacattctcgccatttgcattcccggtagtgtgtatgtcctcccccatagcgtagctccgttgaccgacctgattctccaccatcctcatatccgccatggccttcaaagtaccacctgccaaggtccacagctatgtcaccaagctgctcaaagccaacctgatcaaaagcccaccaatctggtaccccgccgcatcactcgcccccccttctcccacatttctccgcgagcgtgatccctccggagccacgcccaacgcccagcttcctttcgaggaggaagcaaagaaggcactgagcaagaaggaggcagcaacagcttcatcatcatcgaaaacaaaggagctgtcccgctccgcaaggtcacaaaagcaccttcgctggaagagtgaacgtcccaagacgatcgtctacccagaggacagacttcgcagacgcttttacgaggaccacccttgggagctccgtcgccccagatgcctggtcgagacctctggagatggtacccgtcgcaactgggagacgcttctgcaggagggtcgatcgattgctgacttgaccggcgaagagtacgttgcatccgatgtacttttgtttcgtctattgtcgatcggaacaccgacactgtttcttccaatgtggtagcccactaatgatattggatgtgtcttgttgatgaactgtttcctctttctctttatagtgtgattcagcaccagttgtacctcatgtcgacaggcaaatcagagcgggaagcataccacattgcgacacaggagttttatctgcacagagctcaggaagagaccgaagcccgtgtggccaaggctcaagcaatggcattcggactcaagccccgcaggagcgctgtcatgaatggactgaggcgtgaggaggaggccattcgccaagccgagttgaatgcccccaagttttaatatcgggtggttgtcgttcatggagaacaatcggaagctttttgaggaccaggatcattagacagtaaatagcataacagcaaaaaacacaacggcttcatgcactcatgcgagaactgtgagcacttggtgctcatgtagacaaaagagtcaaggcaataggcaggttgattggtgttgtaattgtattttacattgctattagagtcttcatgatgtggtttctgtgacaatcagcgcctgcccattgcagctgtcccggataacatggccatgaaatgcaaaaaaggcgaccaacgacagggaaagcatgttggccgtgattgatggaaatccccactccacgtgcaattatgcagtggccttctttgccttggccgccttcttcctttccttcttcttgagcgcatccatgctgatcttgatgatgttggtgtactggaccatgaaccgctccaaatcatggggttgtacctaagattcaggagaacagatcgattaagacgaaatggtttaggatcgaaagcgcgcccatacactgaaagcgatgaccacgccgcttgtgggcacgcaagataaacggagagggtcattctcatagacggttcttacgagggtggtgtatttcgtcttagtgccagcctggagacggatcagtgtagggtactctttgctctgctcatcaagatccatgtccttttcctgctcagctgcccggatcttttttgtagagtaatcgtctagtgatatttgattaaagacagattgagctttccggtactggtcgacggcgcctagtaaaaatatccgtgagagggaaaagcagcaaccgacagcttgtggcagtgaaagccttacgtctcttcatcgtcaggtaaacagaatttgaggtccgtgattcctcaaaggccttcgccatcttagtcagaaactagatgttcagggcaagatcgcaaatcaatgtcagtggctcgtgagcatcaaagctcacactgcagtatggccgcacgcctccctgagcagcttcgaagcatattagtgtcgaagtatgtcgcaataccttgtcgttatccagcagcatggtgttgaagtcgacggaagatggaagaggtgtgaacaatggatttaaagatcagagccctgccattgattttcacgtcacccgcaccgcccgctcaacggtgagaaattttgcgtcctgtacaaatcgggctcctgtcttcaagtacgcggtcgcctccacagtgcctggcccacagcggtttagatttggtacttgttcactcactaaaaatctacccaagctcctccgcgagcacgtcatagctgcatgcaccttcacatattccgagagacgaagaaggagaatattgtcgacgctgaaagacatgattttcaacgacattcgctctgttggttttgggcatgctctcccactaccgtaggtattctgaccgttgtgaaagcaggtgatattgctagaatacagcgtatgcggaagcccgagaattgaaaaacctctttgttacttggaaagggttgattagtaggtggtgcattcttggaagcaagcgtttcttcgacaatcgacaggctattgacggttcaaacattaggtcttctttattctttatgtacgttgttcatcgacatgccgacgttttctaatcatatccccgaccttcacgacatacggagcgacagataggtctgggcgatggagcatgtgcatcccaaaaaagatttggccctacgagaaaacgagaagcaattggtaagtcgacattttgtttggaggcgctcataacactttacgcactagagagcaagagatggtacttacgcctgcgcttttgcgattcttggaaagcgccaggaatacatccgagttcttcatggccgtcaactgatcgatagtcaccatgtggcatcgtcggcatgggcccaaaatctgcatcagtcaagagcgacgataaaggtaagctgggtgttgggtgctcatttacaacagcaccaaagtaagctcatttgaacaaaataccgataattgctcttacatcaaacacttgttcaccaatctggattctggcccaatggtcctcctcaaacccactcgcctggcccttggtgacgaagttggctcggaaactgtctgaagtcagttcatgcctcaacttcttatccaagtcttcagacaagttggccattctccgaacggcgccttgtccctggtcttgctcatcaacccagtcacggacacgttcgaccgacttgtccgcaatcagcagaaacggactctcgttcgagagaaggatgggagcaccagccggtgcattcagatgcgacttgacaaagcgcgacgatggggatactttgccggacacatcgccatcgccaacgagaggcgaggcagacggggacaaatgcgagggattttgagaggcgatgggctgtcgggccagacggcatggcctacccaaaaactgggagaaccactgattgatgtctggcgaggtataatgaacaaccgcagtgcagtccccacatactctggatgagctcttggtagcctcagtcggcatttcgtccagcgagatgtagaggcggtttctgcctttgcttatgatgctttccctctcgagtgcgtcgacatcagtgtcctgcacgtcgtgctcgataaccatgagattctggtctagcaaaatctcggcgcggatcatgcacatgcgtgggaaccgcttctgggtcaacgccgccccagtgatctcatccaccaacatccactcgcgatcgtacagcaacccatgaggagcaattggccagggcttgcctcgcggaatcttgtagccgcggcaggacttgatgggataaataatcacagattcaatactcactggggcagaagacgtgggcccgaccatctcgtgttgttcaccgatgagatccacgctttgtacaggggcatctggatcgcttgtatcgataaagtactcctccaggaaggctataaaactcaccacatcgtcaatggacgacattgcgccaagcgagacgcggattgagccggttggctttccgttcaggatgtccgtatcatcccagcagacatgtccagcctagattttttaaaatgattgacatcatataatgagtaagtgacatccatatgatgaaagacgcaaatccggtgttctgctggggcagcggagccgtacctccaaattggccttgacttcttccgttgataggtccagccaccgctgcatggagcccgggttacagaatccaccagtgcgcacatgaatgttcttcatgctcgccagcctctccacatcaccatacccaatccactgtccattgcttcgcttgaggttaaagttcaagatcggtccatatgccatagggttgccaactagccgattgcccgtgccatcgttctcgttgttttcgtccgctccttccacgtagatctcacaaagaggtgcgccgttgtaatgcttgagcttgctcatggcacggtacaatgtccgatgaagcgctgtcacatggggtgagatttttgaataatctccataaattgcgttgacactctcaaacgccagatcaagtgccacaatatccaagtaattcagcgttccatcctcgaaccgtccgtgaagcgaagtccggtacacttgccagtgctcgcccgaggtgatcgccgacacagtgccacctccaaaataccgctttcgtaacttgtccgccaattctgtcttgacaataacagcgccgagccctgttgggaatccaaacatcttgtagaacgaaacgacaataaaatcaggactcgacgcgagatcactcagatcaagttctgaggtcatgacatacgatgcggcgtcgaggaggaccaaattcttggtcgtccggttgttgagacaatctttgacgtctgaggtccacgagagagggaaccgtcgtccactaaagttgcattgcgctgggtatgcaaagagattgtaggtcgtggtatcctcctctgagacactatccgtttccttgagtgaattaacaggagctgaggtgttcaagtctgagatcgaagagctcggcgagggtggcggggaagggtgatgagacatactctcaccattctgattctgcccagatttccgccttgccaaaagctgcttctccagctcctgctctgtgactgtcgcaacgtcgatgctactatcctcatcaagaacaagtccgcgtaaccccactaagcttgtgtgagcctcgcgaaggacagtcaacttggacacggggccagcggtgcctggtgaacgtcttgtccaaggaaaggcatctccaacgagtttgatgccagcagttgcattggcggtgaagatgatgtcccattcgccgtgaatagaggccttgaagtgctcaaggaccttttgccgcgctgactccactcgagccgaggtcgcttgtgaggagggagatttggagtgtgggttggcatagaggttggatgtgagatctgctgtgaatttgttgagatgggcttgagacggcagtgttgctccagcatggtccatgtatatggcatctgcacagacaaaatctctaggtcagtcatatgcaaggagcgtacatgaataggacacgatcatgtatgtgtttggtgcaaactacctttcatctgagggtattgttctcggcgaatatcgtcaatgctgccgctgtatccatatccgttggagtcagtgccttcaaggaactgggtcttcagtatggctgacattgtgatgttgaggtcggacggggttgtttcggtgggcaaagttggattgagccgagcaaagctgagagttgacgaagttcaatgtgtggccaaaagacgttgcatgagggttgcgaagagaagaagagacagcactcggaatgagaatgcaggttaagtatgcggagagctgtgagcgaaaaccaagtttagccgtgggatgtgacggattcgagttactcggtggtgcaacccgacactaatgctgggtctctgggttgatgaaaaaaaacaatgtggatcttggtttacgttgcggaatcaaatgctggacagcttgaccatacccacacaaatagagttcgctgtgtgacccacacaacgaatcacagcacagagctttgacgacttcctgggtcgcaatcctgggggcacacagtgtgcggggaagtttctcccgtaccattccgctctcgccagcatttttgcaactgttcgtgcataaacgcgtcgagcatcaacaatatccaacgcagggggtcataatcaaggcgctgctgcatcaagctttattagtcgtctgttgcaaacaacgaaaagtcgatccgccgccgaggagcatcccggcgcatggttggtgacgagataaacgtctcaaagtgggaagcagccagtgctggagatctggccatggattttggagttgacatgagcagcgaagatgagcgagacgctgcattgttcccactctccataccaggattctccgcagtgcgtgctcccgacgcactagagtggtaatttgctgctattctgacgtcctgcagttttgaggacggcgttcctgggacaaaaatcgacttgggcaccccttcaacggacccaaacatcccatccatatgagctcgcttacgatccggccgaatcgcatgcacttcggccgagaaccttggcagcccggcttgccggttcgcggtgggtgagtgcgacgacagcacagatgtggtttgtgcgcgctgaagacttttacgctggggcgattgcatataccgttgacccggtttgtcgccagcctgaaagctggcactataactgtcgccttcatcgtcctcgtcgctctcaatgcctcctgcgcgccttctcttgcctggcgatcccagcactccattgtccataatgccagacgcgtcggatccacggatgtgagatgcaaatgttcggctctggtgtacttgatccctcctggtgggcgtagatggtataaacaggttagtggcgatgtcttgatgttcgccttctgcaccctgacgagaaaatatctgctgagaatggtagcgccgaaactgagcgcgcccagagggagttataggtgtgtgctcggccgtccgctcagcgtcttccggaaaatatccctgcttgcgggatggtgtcgaaggtacaaatgaatctagcggaagcgacagaggagtgttgaagttctccaacgatcgcctcgacggtgacaaatcgcgcgttcgcctcctagggtagctgcgtctcctcgccgcgctactggaaggacttttgaggccctcaggactgagggtagaactggtactgttcatgctgttgatgactccccaggacgtggtgcctcttccggcaagaggactctctgaaggattcaatcccccatccccattatcctcggtatcgctgttgccagtgtttcgatcgcctccttgcgatgtaatagcatcagccttggacaaaggtccttttcgtcgaaacatctagttaaaacacaacagttgagtgccacatgcatcgcttcatcaatgactggctagtttcgatcaactctgaagtcattatacgtaccttaagcacctcctcactctccttgtcgtgatagaacttttttagtttcagctttgcgagctggggcggggcgtcctcatcttccactagaagaaaatgattatcgttgtcagccaactttcagttcaactttcccaggtctgaccaagatgtatgattttctaggagactgtgccttactctcaccgtcaaaggcaatggttgacggagggcgttgaattgctgactgagaacgtgaatgtgccaaagctggtctagcttgccgtaattgtgtggttgaagacgagataccggacgtggaagatatggcatccaagcctttaaaagagccccgtgtcattgtcacttgtcgatttctaaaaagtgagctgttcaaaacattcctggcagcgttttcagaggtggagttgcgactcatagaaaatccgtgctttggggcaacattgtcatttggtgtactcgatcccgtcgtcggacttggctccgcaggcggtggctgtgacacagataagagatcgagcgggcgtggcttctggagcacacccattgacatggacctcttcatcatggacctctgggaccgcggagacgttaaaaatgttttctccgcaccacacttgatcgacagtttctcaacaacctttggcagggaagacgcgtaaaatcgagaaacgattctcgtgaaaaactttttcgcagaatccatgtccttactgcgcggtgtctgtgggctcatcaagccaggtgtgggacggtcctcgagactggccgagatgcagagttcatccataaacaggttggtggccttcagagcacctgggtcctttttgaagggcttgttctcttccagaccatacttgtcaatcagaaggagaatatggagattttgtacaatctggatctgagtactatagcaacaaagacatacggtcgtcagcgaatttcttaaacgtgttactgacgcctgatggaccgggggtgtacctactctttggtcttcaactttctgagctgcattcgcacatcagtgtccttgacgctcttcataatctctgctttccaggcgtcgagctcgggtctttcatcctgaagaatggcatagtggtcctgtgatttcgagtctgcagttttaccactattcacctccttgccaagctgcttatacttcgacgtcattctcgacggccatatcctcagaaactcaatgatgaatgccaccagtttttgctatacaagaagaagatcaaaccatcagcataacgtcacaacaatgaattgcatgcgttaatcatccgcctctctcgtacctgcgcctcctttaaaggcaaagaatgcttagcagcgagcgccgtgatgtccttagtagcagcgttcagccgcttgacataatcaatcacagtgtgctgatagatgtaaagcagtgagtgttctgttgatactattcataatgcgtctgaccgatgaagttgtcaatgggcgtacctcgtccttgtacaggtgctcgatgtaagccttgcgtatcccgagacataagtcatcgatggtttctgccgcggcgaatgctgcaggtatagtctcttctagtgcttcgcctgggagtggtttagaagatgcggatctgaatcggaagtggtattaatatgtttcctgcaggagggagaaagccacactcagccctatactttgtagaatacgaacgtactttgctgcatccacgaaggtatcggaaagacaagaggatggtctgatacagtcgaggaaaccggccggcatcacatccagacggtacgaatgctctgatctgggctcggtgtctacctcgtccacaaatgcacccaaactgccccatgatttctccatcattgccgtgctgaagggtctggtcttgctgcgcggcacggggcccgcgaaatgggcctctcgtagatccacactagcctctagaatttgaatgatgccttttccttgcgtggtggggcgcagcaaggcttggcgggtatagcgttgactgagcgcgggaagaacagagtctttagctgccttggcggattcctgtgactgtgagccgccctccaagaatgagatgttcaacagcaggacatcacttttggaccgtaaagactccaacagataacatgcatcctcgcaaggcctttggctatcatcttgtggaaaacacaacaccgttctcgtggtcctgatagagtccaggttgaggttgactacgcgactggataaccgctcaagcacgtaaattgcttcaatttggcctgatgatgaatgcggggccgacacgaatccggaagtacgttttagttcgacaatatccatgctgcagaggtctataacaacaaatgccgttagaaacacgtggtgctgcgacggaatatcatcgactctggaaacaatcaaacttacacttggatgattgagcactgagaagatcgccggaccataaacggtcaactggctgggtttcgttgagaatgctaatgggtgctgaaggaagtgcctgccagctctctttggacagctttacgcccgtccctggattgatctgtagggaccggtaggtttggaagatggtggcgaacgagtataaatctttggctgacacgttaggacacagtatcttttgtggaataatgtgtccgccgaatgccttcatgatctgttccagagtggatcggatgagcattgtcgctgagattctggagtatgtctatcaacattgacggcagccgcattaatgtaaagctgtgggaagacctttggaagctagcacatcctgcctaagggaagaccttttaaaagtgcacaatacgaaccttggctgattcctcggtgttgatccttgcgctggtgtcaatccagctcaaactcatgcgctgatccaaaaatttatcccatagtccttgatcaaagaaggcgtccttgactcctttgagcacctcgagtatgtcgctccgtcggggaccgatcgcaagcgactcgttttgagcaggtcgctttccgtctagaaacgagatcgtttcagcccatgtgcgaggcaaaggcgtaaagacgtacatgtagttcctgatgttgactggcggaaagtgcttttgaagcgaatgagaccgtgcaaagctcgaggtaggcttcattggagactggtatgaagatatgtcgagcccaaagtcggcaagagagtggacaagttgccgccgcagattgaagcaaggtgagacaacagtatgggcagggcttttgagtccggatccgccctgagacgatattttttccaggtcctgagaaccagaggttgtctctgcggtaataattttgcgatactcctccacgcagctggtgatcgtgctcatgctcagtccctgaagcactctgtttgggatcagcccgatatcctgatgcaaacgtgagttgaagaactgatgggtccactgaaacttggggtccatattacattggaagtaaagaagaatcctgaccaaggagcacttcaagagtgctacggctctctttctctgaagctcgtcggcatcgtggggtagatgagtatcgatgatgaatacgacattcaggggaactttgctgtgggacatggccgagaagctgggcattcaggacaacgtccagctcgaagcgcaccagcaaaatcgtccagcttctagcacaagtaagctggagagaagtcactttcggtggttccgcaatgaccttttcccgcttggtccgttgttgctaccgtgtgttttttcgtataaatggatcaaaaggtaggtgttggtgagacgcgtagttcaagtggagcgcgagttgaaggggacaaaaacaacacagaaggccctgcttttgtgacctttttttcgtatttgccactcgtcgtgcaacaagtccattgcctccacgacatttccaccccatggatgcacgagccaaggagagaccaccagcaccactggaccctgcagggaacgaggtctgcttgctgttcctcaagtacggcaaatgccggtatggcaagaattgcaagaagagtcatgcattgccagacaagagtaggtgcagtttgctgacttgaaccaactggtcacacacgctatgcctgcgagaggtactgatgaggcatgtcatgtcgtagataatcctttcacaaatccagcgatgcagagagttccagcacaatctccagccgcgagggagggacccagaatagcatttacggtcaggaaggctccgtatccccggccttcgcagtctggcaacacatcatcacgaccacagccgagacggatagcgattgcagcacaaccagcttcacaacatcaaaagacggctccggagatgcccaaagagattactgctatggaaatcgacattgagtgcgaacggccttcgatcagtgcgaatcctactactgagatcgccgatacacagatgagtagccagcgtcctaaacgagaaccaacgccgaaaaggctgcccaagatcagaagcaaatgccttttggcgcctcttttcaggacaacagtacctctcgggacactgtcgaagcacagcacactgatagcccgcccttcgactagccgtgaagcgcaaactcggtattcccggacctctgctaaatccacctcgaaaccaaaaaggaagtcagacctttcactccatcaacggaccacccaaaattcaacggcaataccctctaatcaaatcagtgttgatgcggagaaaatcgaacagtggtatataaccaataaggcgcacttggaaccatcaacgcggaaactcgtagtcttgaccaagcctaccactgttcgccagaaatctcagctcaaagctatgcgcaaacatcattgggaatgtgaactcgaagtggagggacatcttaaacgcaatcgaccaacgacgtatcgcctcaagatttcaagaagtcgtatagactgggaacgattagcgccctatatcacgctgatgatccaggctgtatgaaaccaccttgtccgaaaaatgctaattctgcacccgtactgttcgatttatcatacacgcagctgaccatgaccgtttcctgtcaactgtcaaataggcctttgagatggacatcaaccatcagcatttaccggcggtcgggaccacgctctgcgcattattggagcacaaggacttggatgccctacagtgtgaggagcagcttgtctcgtggggactgacgcatctcgatgcccggcgctttgtgagccatctctgggacctcatggtggctgctgcaggagagtcaagcattcgcggtggacgtggcataggacttcaggtcaggcagtgcgagcacagggccgatttcaacacgattcaagaacggctgaccgtactaaacaaaccaccggcgtgaccaggcgtccttccatcctcagctcactttccactttgaggaaactattactgccagatttggtcttgctctttattgcgacaatcttggctacatatatctggtctttctcatcgtgtttaagcgcgggcgcctcgcttctcgaccatcacctcatccgatgcgtcgactcccaactcctccaccagcccgttgtaagggtagttgcggcgagtgaaatggggttcgggcctggtcagggagagcaggtatccgaatccaaggaaagcagctgctgctgccaagaggcccttgactccagttgaggcattaaagtccgatacatccggtgaccaaatgttgagcacttcgtcttcctctgggacctacacatttcagcgttgttgcgtgaaaccagagcagatatgcagatattggaaagaattagaaagccattgaattctcaagagaaaagaaaatggcggagaggcagcattcatttgcccagctgtatgagcctcgtgggcaattctatgcagggactgttgccgccaacgcgaaaggctgtggggcatcacgttcaggtcatggtattgaatggtctcacagtcaagcgtatgaggataagtacgtatgtttgctgcgcaaccgtcctcagtttcttttgcttcagagcgaggctgcagaaaagcacccatagtcgcgtttcctgtcgtgtgcagttcagtaaacctgagggaggcacgtaccgtctccccaaagttacgacgatcctgtaggtcccaataacctgcagagggagttgcatcgcgccactgctggttgtacattggcatatttggatacgatccgatctgggtctcgccagtgatcttgtctccgggcaagaaccccgtagggtctcctggaatagctgggtcggccttcgtaccggcatgcccttgcaatccttgaccttgaccgacggtgtgtttaaaacgacgactgacagcaggcgctgggaaaggtctggaggcacctagagccactttgcgcgtgaggaagcgtgcggcagtagacattgttgtgaggctgaatggtaattgttagtctctgatggtcgaaagcgtaatgtgcatggaccacctcgtcgcaagtccgacaaaaaaaaggagactgaggcgtggaaataaaactatcgttaaatcctcgtgtgaaatgctctcctcgtgaaacttttattcaacctcacctggatcaggtacccgcagagatccatgctcttgtttggcagtgtcaacagaggcgttgagagccatgcggtctcgcgagggttcaagatgccttgtatcagggtcagcgagtacagcgttcattatcaattctcgtgcaatttcatcgtcggatcgatcatccatataggtcgtctacaaaataatccccttgatcctgtggcagtacttagcccactgggacagagcaagcatcgttgtcgatccatttcctgagaaagccgagccggtcccaccatacatgcgaaatccatgataagaactttggttttgaaggccgaaaagccagaaaatctctctgcttgctaaatatccatgagatcgaccacgattcagtcgtcagtcagcaggcctgtagatgtcctgtacggtcgctcaacctcgacctgaaagtctttcgtcagtaccatgaactcgtgaatataacggaatttagctaggaacaatcgacttgtcggcggttgatctggtctacctgtctctggcactagcggaatagcagcaggctggggcatatagccccacaagggtagtcgcctccaactgggcggtgcaagagtcgagacacacattgttttcgccctgactaacaaacgttgaccaaggcccgttgtggtctagagggtcctttctgccattttcgccaaccaggccctctggagcaatcaggctgcgatgccaattctgataattaccacatcgagcctgcctcctgaatgactgtttggaaaacggttagaagggctacccgctttaccttacaagttttaaaaggcgtaaagtttgaggggaccatgccagaaagaagcttaggagctggggtgaggattaagacgcgctctgtaagatcttctgtagacgcgttgaacttgagctactcatcccaatattttttttctcatcggcggttgctttcccaagtcgcaagcaggccttgagtgatcagaccaaagttgtgtatttgaatcagaattttgcgaataagtgagaccaagaagctgatgagcgtcggcgagcatgaaatgggtgaagttttgaagcgtggaggtgtcgctttctgtaaagcacgtctattgggtatggagggtgcaaggtcgtgccaagaggagagagagaagtcgcggtcgaaagataaaaaagaaagagcgagggggctcaagatttagccagatgcaaagctcaagggtctcccgccatcggcattgccacttgaccggtctgtcccgatttggctgtttgtggacttgaaggcagtcgagaatgtaccacttgcatcgtgcatgtctcagatttgctccactcgcgatttgcaccactcatcatttgtagcaacggctgcacatcgcctcgtaccttaaaaacgtctgctttcccacatttcccgcctgcaacacccttctttatcacttcccactctacaaatgactacacagcctttcccccccgccattcagattgaggaccaggagcccgagcgcggtcgcaagcacgacgctcaccacgtcagcgtctcgtctgaggataaccaggagacccaaaaatctcacagccgtcgcagctccatcaccgactttgtcgagcgtctccgctctcgttctcgctcccactcccgctcccgttcccactctcgcaagagccccatggaggacctcaaggagggcgaggaggtcaaggagtaccaatactcgcgccgcaagtccaccgatatgcgtggagagtatggccctatcatccgagcccagacagagttcatggagaacttgcgtttggaacaggccaagaaccacatcacccacaacgccgatggtattcccatccctcccccagtgaaccctccccgcgagggccgtcgtcgttcgatcattgaatccctttcaagatcgtcttctcgaggacctagccgggagtccagccgagaccgaagcagcttggcagctgcggataaggagtacaagtactcccgtcgcaagtcgacagagatttcaggaccttacgctgccgcactgcagtcgcaaatggagtacatggagaacctgagggaggagcaggcaaagaaccatatcacccacaacgctgacggtatccctattcctggaccagtcaacagtggaagcaggcgatcgagcgttacccacgtgttgggattggacaagtcgcccctttcattctagaaagcaaacattgttcctgacaaaggtcgttctccttagacaggtcctgcttgctcttttcaacttcccaactcttccaatctagtcgtatacagcagtacaatacagcgcaacctttgaatattgttttttttttttttttttgtggatgggcgcccgcctcataattgttccatgttgttgtcattaggattgaacttgctctcatacgcaatcgtactgtgcaactctccaatgttctcaatttcgcatacaacatgatcgccatgttgcaagaacactggcgggtcgcgcttgaatccaacgccttcactcgtgccactacccattttcaattgaggaatagtgtcatttaaatagctcaatctaacattcagttcatggctggtgatcacacttacgttaagatcacgtcgccgggcatcaaggtcgtagactggctcaaaaatgagatctaaagcgcacgaaaaaacggctggctgtcagaagcactactctgcaatttgtgggctgaactatggttatatgtgcacttaccaagcgagggacattgaagatcatgtccgaagtggaggagtcctgcatgaccttgccattcactgttgtcttgatcctcagctggttcgggtctttgatcagggccggcgacacgagacatggtcccagtggagcaaatgtgtcaaatgacttgctaaagcaccattgtcctgagcccaggttgttgccttgccatttccttgtgctgatatcatttccaacagtgtatcctgccatgtatatacatcatataacattagtcacaaggacaagcccaggcgtgtgaaaaaaaaaagatttaagacatgcatgtaaaagtctttcgaagcggaagatcgttcgttaccaaggacataatcaagcgcctcagactctttcgcatttttgcacggctttcctatgacaactgcgagctcacactcaaaatccgcctggttgttctctgcgatggaagggactaccacaggttgaaagggatgttgaagagccgaggacggcttcatgaataggatagggtattttggaatgggcatcttggtttcttcagcatgtcgtgcatagttgagaccgatgcaccgaaagatgggtacgtgggccaaaggggagaggagcttcgccactggcacaacggtgtctgtgacagacgaggccgagcgagagaacacgtcgcctgtgatgatctttgcggtcaacttgtcctgatcgcccgctgtggccttcaaagatgcgacggctttcggccatgaaaggggggattgaggttcgcccgtgtaaactttgccatctttgccaaggaacctatacagtgcaacttgccggtcagcgggcgtaaggctgggtggggcgtcggggcccattgaagtcgcgcgatcattcaaaaagaagaagtctgttacctaatgagacgcgtccagggacgctaatttacaaatgcaaccaaggcctgttaacgaaagccataacggtgtccacatgactgggcatcgagtgattcctaccagtgcatgcattgaaggtcgcatgatgaactgttttggacatgaaaagtgtagagaaaaaaaaaaaggcgaaaaaacctatttctgttcgttgcgacgccaccaaaagagcctcaacaacggccgaaaaagtgaacctcagttcagacgcatctgaagatccttcgatgtgcagggtctcagccattactcagaatatatcggcgcacctcctcactcagttcttcttggaaagaggcgccgcaacacggtctctttacgagacgatggacattgggatcctagggaagctgcttgtgtctcgaacaaaattatgcattcctctccgccctagaatcgtttattactagtctaccgcggaagcaacatcaacgtgagaatgagtacaggttaattctattcttgcgtgaggtagttcaagtagagcttggcgttcattcgcacaaaaatggccgtagacatttctgggcataggacaatcatgatctcacgcgctgcagtaaacacactactggccggcggtcttatggaagtgagagggtactttggccttgactatgaggaggaaagagtgcgcgccgcggtagtgaaccgagatcaatttttgttcgcgttcgtactatgttggaccgattaagctggtcagcgaactgttggttcacgtctcattcactacaaccattaccacagaatgagtattttttgtcatcatttcgccaatgcatgcatgtaccaacccttcattggaatacatgaaattttaggggcgcaatatgctatgccgaggcgttcgttggtgcttcgcctacatccccccttgctgcagtgggagatacgtggaccattcgttgcctttagcgaaactgtcaagcgtgttacggaaagaagtacagaactgtacacgatcaaatggaacgtctgtactaactcatttcagccgaccattcaggggtgatttgatctactgcttcattcaagtccaaatgatcggatgcttgagaaaggaacgtacctgcccacttttcaggccagatatctcgacaaaaaaaaagaaaacggtatgtacggtctctcgagaaggctcaaaaggtcatgtgaagcgagaccgagcattcaagagtgttctcagtttgacagaactgcgttgtcatcctaccttcagaattaggattttcacaatgtcatgactgtgcggaacttgcgcaccgagcgcgtcagttgctcaagatgcaaaccttggaggccagggacctcgaagccctggcgaaagagatacttgctatgatacatcctaacttctcgctgccacattagccaaggtaggcatgggaagtggaacgttactactcgcgaagtagagggcggacaacttttgctcaggttagcagagaggtcttgaagcagaaaagttggcgagtgtataccagtactctgtcgctctattcattcattgccaagacgggcgctaacagacctttgggtcatctgttgtacgaatgaaaatgtaaaaggctccctcatgtcatgcaaggccattttggacttttgggaaactctcgttaaccaagctagtgacaagaacaacatgaccaagaccatgaaaaaaacaacggggtccttctcagcgagcaggatatataggctgacctccggcctcctcgtttgctattcttctttcgttctcaaaaaaaaaccaccatcgttcaacaacacaccctcaatcaaccccttgccaaacaaaagacgaaacattatgagtactaccaccacgtctcgcccagccgtaatccaattctcgtcctctgaggatactcgtggccttccagttcatcaagaagaagagagcgagtcgcctcctcaactcaaggatctctcgctgtcgctcacaaggaccaagaccagcgagtccacgggttctagaactcaacgtcgccgcagctcccttgccgcgcttgcagaccgactccgctctcgctctcactcacggacgcggtctacctctggacagctagaaagcggcgatggtagtgctagtggccgcaactcgatcgacgaggactaccagttcaagtattccaacaggcgatcctcggacttcacgggcgcctacgcggacgtggcgagagctcaggctctctttatggagaagctgagagaggagcaggagcgcaagaacatcaggcaaaatgccgatggcataccaatccctcaacccatgcaccgtcgtcggtcgagtgtgactcaaatcctaggcatggacaagccattgttggcacgataggaaaaaaggggagctgcccctcctttcaccctctctgtcacgtcccgcgtccccaggcgctgctctgcgttacttcactcgctctcttctctccccttccctctcctcagttcctcgggaaacaaaagccattagaaagcccataatatgggatatggtcaatatgtatatagcttgccttctgttagcgacgccattgcggcgtaatttcacaataaatcgttgttttaccccagctctgagcatccctcatcgatcacccacttctgtatggttaccacagggtgagcgacagccagtaaaaccctttggttagtcaatgcaccgtccaagctgcatgatcgatagtcactttcctagcaaccgcgcataatgccccgcagttgcggtctgctctcatacatgtgaatgcaacttctcaattcaaggttgcataaagagacgtagtgtcgacctgctgacccgtagatgggcggttctactctttacatacccacctgagttggtaccattagaatacatagggcacttgtggtacctacttgcatgtatccgttccctctggggttagcgattatttgtcttgcatggggtgtgttcaactttgcaagctattcttttccccccaagtggctgctactccttttttatttaccgagggcgtaaaaaagttggcgcacttggctcacattagcgttgtaaggaacctatcaaccttttcgaaaagcgcacggttgccacagacctagcccaaaaatgcgaaaatgcaaaaaaaaaaaaaaactcatatgtcagaatttcgctcttttacagcctcctcccccaagaccctgtcaacaactacacaacatagtgttaccattcaccagatgtctaaggagcataagttttttaatcgcctccagtgcagatcccaggacaattcaataggctcccacgcaagcacgcaagcacgcaagcacgcaagcaggcgcgaaatggagcgggaccatcgaaaaagggagacaacaagcattgatgctttaggatgctcgctgtccatttggtactgctcaacctcctttggtcaaaagaaggcgcagcgaagcatgaccctgtcttactgacaatgttactaattagactattgcgaatgttgttcctagcatcattttttttaagaagaggtccgacacccctattgcatccgaagatgctggactgatcgagaaaagtctatcagcggtacatcgaggcgcaggggtggagcggacatggtgagacttcaagctcagcaaatagaaaggaggaaaggtaagccggtgcctgagatccgtgtgctatgtcgacagaaagaagaagatgctcttgtatggtcaagatcccgagaatagggctattatttcgtcctcaggtcttttactcagacagcgaaatacacttgggccacttgatgcagccttttccgacactgactgggtctgaaaagtaacctcggtttcgatccgagagcggatgctgaacgaaaaaggaaacccattttcgaagcactcggtcgggttaggatagggttagagtttaaattcttattttatggtcctcccgtcggatgtgtcagtgttagggcggccaagacgacaacagtgaggatcgagcacaccaggtgagaggggcagtgtgctctcaaatagagaaactgcctattctaggcctttcccttattgacgatggttttttttcctttgtttgctgactgagtttcgggtaggcactgcatgacgcgaaatccatgatggagtttgaaatatcgacgtggaggcacaatgcttacctccccaatgctcccaacgctgccccatgactctacgcgtgcatcagacaccaaaatgtataagaacctggtggcagccctctgccacttttcttttttctcttctaacactcattccaatctactacatccaacgaccccaagaacaaaccacaaccaacccaacccacccccaacaagaccaagcttcaacaacaaatatacgatggctgccatgaacaacacaagctccgtccctgagattcagcaggtgaacacttccgcccctgctatagcctttgctgaggaccgccgtggacgcaatcacaccgtcacgcctcttattgaggaggacgttgccaccgacctggatcccgtgagcagcgccaaccaaaaaaaggccaaccgcatttcccttgccgcctttgctgaccgcttccgatcccgctcgcgctcccactctcgccagcgcaactctacggacctgcctatggacaggtccgccaccggaaactcgaccttctccatccaatccaacgcatcatcaaagtctcgcaccggctcccgatctggatcgcgctccaggagaacatctgtggacaacggtccctatgccgatgtggtcagagcccagcaagagtttatggacaagctgagagaagagcaggagaagagcggtgttacacacaacgtcgatggtcttcctctccctcctcgctcgagcccttcttcaaggagtggaagtagacgctcaagtgtcacccatatcttgggtctcgacaagcccatgctcgcctattaaatttagtacccctttgcagcactttttcatcttcagcatattaaaataatacttttgcattttcaacatactttctgcatacgcatttgaggatacaaaaccgtaaacagccgtggcgcttgttgaaaaaaatgggctgaggtaggggttgcgcctgatctgtgttgccgccgactactgtcttgccgcagtatctgaactctgtccctgaacatgaactctgtccctcgagtgcgaggattaggcgctcactgctttgaaggaaagtggcacaggcgaggacggcttttgcgatgtcatgtccgtcaaatgacacatagatcaatgcgaaacgtttgactagattcacatggaaccagatactctcttgacatctcgctagatttatgaataggtcgccgaaacacacagcccaaacagcgttaccgagcgagccgatgcatgatttgtctcgtagcgtgacccagtttggtttctttcctttttgaacacgcgcctgcaacaaagaagctcggggcggactggacgttctcaccactctatcacctgacaggccagtgatgtcatgcggtggcgccagaagtgcgccaaagtcaaaataaggtttctcttccttgtaaggaaatgtgtttttttccgtggccgtgggctgttcgctcagccacgaaggttctaacgtgtttctggcgagttcttgaatatttttagatgcatgatcgactctttaccgcagcgcgctgcgggacccttactttgatcctcaaatggagtttcggaaaagagaaggacaaaaaaatataaatacagtaccctcgtccttcgacatttgttctcaacacttcaaacaacactcttcacaaacaactcttagagcaatcaagcaatcaagcaatcaagcgatcttaagcaagccaattaacactaccagaagcccatctacaaccaacacttctcagagcatgaaccagagcgtccacagcaccgttgtcaacaccaccatggccatggccgatgcccctcgtccttcgatccagttcagcagccatgatgacgagaaccgcggtcgcgacaccactgcccaccccatttccggaagcatcgacagcactggcatccctctcaccaagacgcagtccaccgagtcggccaagagtcgccggtcctcccttgccgcattcgctgaccgcttccgttcacggtcccgctcccagtccaggaatcgctcctcaatggacagcggcagcaatagcagccgaagctctatggacggcgacaaattcaagtactctcgccgtcggtcgtccgaaattagtggtgaatatgcggaagtggccagagcacaggcccttttcatggacaagttgcgcgaggagcaggccaggagccacattacacataatgccgatggtttgcccatcccacctcccattgagcgtgagcgccgtcgctccagtgtgaccaaaatcttgggcttggacaagcccttgttggcccgttaaataccaatctctatctcagttttatacacatcaccccatgtacaatagcatctcagtaaaaagaaacttgcacaaagtgcattcattgttgcgaaacgcaaatggcgattgggtttgggtcgtgtcgcacaatgttgtggcgtcgctgaggtgaagggggttgaccggggcgggtcgcaaactttcggtgtcaactctgagtgcatttttatttcacactctaattggtcataatgttacgccgggtcgccttgaaggcgccagagtcctcagcttcatgcttttcccgcagctctttacgcttgactgcggccagctccttgatcttctcttgctcgacaatctctcgaaggacagatgtgaccttgatgatgttcttcttgtactttgccgagacagggatgatcttgatagcatggtcgctgaacttggcatcgtcgtctgtcgcagtcgcagatgcagcatcaaccgctgcggcagagacacgtcgctttgcccattcctcgtggaccaacttttggaagagctgaaggttcttgggcgcaacttcggtcacgtcagccttgttggcaatgatcatggaggggcgtctagtcagtcctggttggtacgcctcgagctcgtccaacagtgtcttccagtcctcgaacggctgactatactgctcattgatctccaaagggtctgtccgtgtttgctgttgctgaggttccccttcgtgttcatcatttgacatcgtcgctgcgtctgcctcgtcattctcgggggtccaatcgtcgacacccttgacctgtctcttgacaccaaactctgccgcaatatccacaacatacaccaagaccttgctgcgttccacatgtctcaggaacgaatgccccaacccaatgttcttgtgagcacctcggatcaatcctggaatatccgccaccttgacctgatacgagtccgggtagtcgaccgtgccaatgtacgggttcagtgttgtgaaagggtaaggcgcaatggccgggtgcgcatttgagacggcctgcagaaaggttgattttcctgcattgggcagacccacgagtcctgcatctgcgatggtctttagctccagtgtcaaccaccttgtttgtccctcgcgtcctcgcgtggcgtatttcggtgctcggttctgggtcgtcagaaagtgtggattaccatagccgcctccaccgcctcgtccgaccatgaactttgatccatcgtccgtatactcgttgatatccagaactaggggctttttgctcatggctgcccgtctagcctcgacgatccgatcctcctctgcgacccaggcctgtgcttcctcaaagtagttgaccttgccctctggcagggcggttaaagagttggcgagtcgtgggtacagcacccatctcttggacatttccttgtccttggcctcggtctctccgagctcgagcgatttgtgaaagatctcctcgtcctcgtcgtccgcgtcgcgctctttctctggcgagggtacttctctgatgatggttcccatgggtaccttaatgatcaagtccttgcctgcatgtccgtgcataagtgaaccttttccatgaacgcctcttggggcggctgctgtgtgaggaatatgttggagtgaggtctcgttcagagacgcctcaaagatcacgttgccgcctcgaccgccgttgccaccgttgggttgcccaaaagcgacaaacttttcgcgatgaaaggatacacagccatcgcctccttgaccgcccgagaccttgatcctgcagaaatcaacaaagttccttccctagaggtaagtagaggaagagttaagggttaaattgggatggatgatggccaaagggtggggcggtagtatgagaagcgtggggaagtgtgcaggtggggcggtggaggagtgcgcgacgggtttacctttgcgcgcagtttccattcgacccccttggctcttcctcgtggctctgcagtgtagtctggcaagccgtcgacggtcctctgccagccgtcgacgacgggcggtgtttcgtctgaggcggtgtctggagatctgtcgtgctgtgcgcgagagacgagcgagaatgaggtgaagccgcgcgccagtgagtgcgggtgagcaagtcggtgagggtatgctctgcagatgcttgcagggtggaggagtcgcatggtcatggccttgtgcattgggtgacttgagcggtgtatgcaggaggggcggagtagggggcacgcagctgcactggcggcacttgttgtgtgtgtgctgctgcaaagcagtccagcaggacggacttgaaaaggggactggtgcagcaaggacagaacccattcagccttgcacagctccgccgtcgcatccctttgttccctgcctcagccattcgctgctctctcagacacgggctataccacacacaccaccagcactcgcagccagcagcagcaaccgcatcccacagcccagcccttcctgccacagcaccagcgcgctctgctcctcgtgcgaccctccctgctagtccgctcctacgccgcgggtgattgccccccaagtcacattccacacccatcttcgcccaaaccccgccatcccactggcgcatgacgctgcccgcagggagctacgtcttttgcgagcgaggccgcatcgccgacatctgcaagggcgtcgagggcatccgcatcgacagcaccgaggccactctagagggctaccagatatacctggtggaacaatggtaccattctccacctcctcccattcattggctgtagaggcagcgacccgctacacaagtgcgcacagggcaccctttttctcattcttgtactgcacttcatcccctctaataccctgactcgatattcttagggccgttgaacggaaccgagaggtcgccacagcagtgtcgtttacaggagatccaacgcacaaggtatgcaggaatgctcgatatcggttgtcggctgatcaagggaagaaatcacggatcaactctgaccctcacgctccttgaactctgtttttttttgttttttggttgcgtgtcgccagatccaagtggtggccatcaccgtacaccaagaggatgtttcatgctcgagactcgaaaaggtgtttgacaagctgcgggaagagaaggccaggcccaaggaggtacatggacatgtctgcgggaaaatgctgttgctcgaattgtacgactatcctgctcatctaaatgcatacgtgcttctttatcatagacgccctatggccagctctttgtcacgaatcttagtctgtttgcatcatcactcaacattgtcttggtcccacatgaaggagactttgacctataccaacggcgcttttatctgaacctcaatctgaggagaatggggtgcagtggcagaagtgcactcacatcaaaatcaccaaggtgtgtacaggaactggagtttactcacgactccgacaaagtgtgcagtcattgatcgtgcgggaaccgagcggcatatccgtcaaaaactcactctgcgcttcacatggtgccttatagcgatgcccaacgggaaaaattcaatcagctctacaagatttcggacacgacagactttgaggacaccgtgatccggcttgtggacctcgtgcagaacagtctctttattttcggtcttttcaagtcgtctgacgtcgatggactgttgtgtaatgccaccgagaagggactggacgagttctacaacacgtttttgagctcaaaattccaggtacatctctctcatcgcaaacccatgacttcaaccagcaaggacaggacattgtgagctgagccatgtgtcgtactttatttcctatctagaaattctcatcaccggataatgtactggatccgaatgtactggcaggaatgctcagcaaaatatcaaatatcaggggcaaattgcagcacctagtcaacaatgtaaggagtcagcttctgccgttacaattgagctgaaatcaccgcctgtttctcaacatggattcttttttatctgccccggaaatcgttcataggtaccgaaggatccgtttgcggagccagtagcgttcattaatgcagtcaaagcctttcaggtaagtgtgttctagatctcgggaaattacccagtctccttggatacattgcctccaaaattcagctcttaaacgggagagcttgttcaaaataccgttgacatagatcaagaaaccggatttgaaggcatgttttctggatctcaaaacaacggaggcgatcacagcagcctatcaatcatcgttcaatccacagggcctcaaggtgcacaaggtcttgaaaagtaaaatcgaggatttttcaggaatgacagcagtcaatctggaaagtgaaaccaccgatctggaagtgttcgcaaagcacatccacacagactccctgaagcaagtctggcgtgggaaaccaaaacataagcctgacatggcagatgccttggctaatggcgattggttgacaggaggcaaggaacttggtaaaagtttggtccgcggactagccaaaactgtaagacgtcaaattggtattttttcatgtgctagtgacacgagtatggaatttgattgaatgcccagcattaatggtttgcatatattttttttcatcgtagacacgcgagacgaaaaacgcttcacagtcattgaaaagcatagcagcgtaagtattgacgactgaacattgatgcggcaacgcatgcatactgtctccttaagcattgtcttagccgtggtttaattctctccgtagtggaaagaatcgtcagtcaatcctgttaccaaagggaaagaattcatcgccaatcacaaacatgaaggaggggggaatgaccgatgataccttggtcacctctactccagctgaccgtaagtattctacatgagtcaaccatgagcacagtgtttattttccgttttctgagcatgatgacatttccacgctctagactacagccccaagtcggacaacgagaggaacgatggatacgataccgacgatgcacccacgtctgccgtgattgccacgtcgacgacgaatgtgcaaggctcagaggaggagacgcccttcatgtcaacgcctgacgctggtcaccaatcctcctcgaccgccgtggtaccatcattagacagcctgtcactgctcttttcacaaaaaccagagccacttggtccacctgtcatcacggcgttttatctggacaaaaaaatcaagcgtggcgaatcccctctcccttcgtcagcttcgccagcatctctatcgcccagaaagagatctcaatccctgacgggcttggtcggccaagagaggctgcttggatgtaggactgaagctttcaaagggataggtgccatcccggggatcaccattggatcgtacagaaagattgtcaaacatccttcacacagaaagaggtcgcagtcttactcgtgcattgatgcaaaaggcactcgtttgcggccgctgaagaggtaactacctacacagtagctttgcaggcgaaaaagttggcgcgtataggtctttggcttcgcacgatggcagtttggctaacagggcgtcatttgctgtatccacagtctcaccgtagagtgcgacacacaaaactactactcttatcaactgttgaaggagaaggaggaaacgctccgggcaatgtacgacaagatgcaggtaaacaaggatgaaaagcattcagatgatctttggaaaccttgttgctgtgataaatgcaattttgaaactgacgcggtcttcatggtgctgcataggcgatggaaaaggagctttccagtcaactaatatcactaaaaaccatccttgcagatcgcgaaaagcaatttgaggtaaagggagacggcttttttttttggcttctcattctcttttcgccgtgtgtctacgttttccacggtatcattgctaaaccacaattctgttttcacgacttttataggagattgaacatgaggcggtcgatatattgaaacaacgacgcgaactactggccgaagtcagggacaaggaacatgcgacccagagatcggtgtaccatctcgagggaatggtgggcaagttggtcgagatgcgggactttactggcgcgtttttcaacaaaatctcctaccttgacaccaagctaccggtctctcaaaggagacttgctctatggatggacaaattgcaggcgctgcagtcgcaatggtttagaaccattggccggtacatgattgtctatgcgcccagcggcattcgaaaccgttttgtagagtgggagaaggatctgcagctggctgtgatgaaggctcgggaacttcgaggcgaagtgggtgattttcatattggcgccgggagctcctcctcaactccacagacgatcgcgggaagtgcctcggaatcagatgatgaggccgtcgaaggttgcgagacagctacggcgactgcgcacagcatgggatcaaatggcgtccatgacctggcaaggtcaccacagccaagatcacgcttgaatagagacctctcacggaccaactctgaagtttcggtagggccgtgtatgattgatccgcagtccttgagaacggaaggcgatgacgcggagaaggacgtcggccggtttttgcagaaagatactgcagtccgtttgcacggccgagtaatagggaagcaagagacgactttctcctgataatggctctactcaaaattaaaatctgactacgaataataaaatcttgcacttgaagagagctagtgcatgtcgtgagataataaaagtgagtgtttgttgccagtggttgaaatcattagatgtggagcagatgcttaccgttattgctggcttactcgctgactcgtcgaggtcagctccattcagctgttcagatggcaccccttgggaggaatgttccgaacacattgggtcttccagcggcggagggctggtggtgatggtaggcacactcgtcggccgaatgtacctgcaacagggcgtgattggccaaggcccaccactgatccagatcgacactcctgagatgaggatgttggcggcggcgttcgtgtctcttggccttgttccataaccgcattcgtacgagatgcaggagcggttcttgcactcagtgctgccgtgaagcttcctcgttttgatcgaggtgccgacaactctcctggccgtggacaactggactcgcgagccacagtatggggagatctgactagtgcagaactcatcggtcactgccaccagcatgtccagccacagcaagtgctctctgatccagtcacctccccacttcatgtggccaccgatccttccgcccacgcaggatcctgcggctccgtatgcaatcgcagtgacgaccttcggcgcttcctctccgggatgagaggccaatgcatgatccttgatggaacgcttcaggcgcgcggcaacccgcttcttggcgcgcttcttgcgcagcctctgagtgtttttaagccgaagtaggcgagggtgctttttgagctggaggagtggctctcgtgcgtctcgacggatagagttgatcatgaaaacatcctgcatattcctggcgcaaagaagcgagttctcgggtgctgaagtcgactccatagctctctgcaacgactggttatctccagcgaggtcctggtcctcggcatcttcactcctttcttgatcgggaggctttctcctcttgcctcgctttgcctgctccaagaccttgatcctggcttcgaggtacctcttagtgaaggagatgtcttgcaggttcttggctgaaactcgggtagccttgggcaaccggatacgctccaagagttcttgacggctgagatcagtcgggacagagctcgaggacgcgtcgtctccacgcatcaagtccatcgttccttcatcctcttgctcctcatcttgctccccttcgttgtctcgctctaaatccaaaaaaaagcagtagattccagcttggtgaatcgagagattgcaacttgacatgttgatttcatgaatcatactcagagcgtacctgtaagcctggtcaggtgcacaagcacctcctcaaatgtctggggcaccacttcgagtgtcgtccttactcccgggtcacctccgccactcgccaggatcttaccaggattctgacgaacagactccagcagtagcgatgtgtctaagcgtgcaggctcctcctccagctggtggttcttccaggtcacaacgtgcttggtaggcggcggatataccttgtctgggtgcaactccataaacttgatagccttctcctttttcgaccagtaataagcctctttgcgcaaacgagtctactcctgctgttgctcgagaacaccttcgggatcggaggccgcagatcgcttgtaggccttgatatcgttggccttctttttgacaatgtcggcactcgcctcggtcgcgtcttccagctgctccttacccagtccatgatgcctgatctcggactgccagaaatgagatgatgcgctcacacaaggtgttttagctgcctttcgctgctcatagtggcttttgataggctggcccttacgcaacgggccatgcgggatgacagtgcctaggatttgcacctggtgttgattaacgaagacgaggctatcgaggatcgaaagcgaagttagtgcctgcaaaaaaaatggatgtattgaacataccgctgcacaagtttcattaccgatttgcctgttcaagatggtattcacgacaccgctggtggataaaggccatatcaaaaaaagctccaagaacagaggccttgttctctctgcgggatgcatcaatactacttcacttggtatagacacatgcttggttttataattccgtagttcacaccgccgagatagagcctaattggacttacgtggacatgaacagcgctgtacagctcgagcccgtgccccacatagtagatatcactcttgcaggtattcgcagagtcgatggtggcgcggaaggtgactcgggactgagtgtgagtcctgacggtcgtggagcaatcaaagtgaagtaggtcggctgacattttcgggttgatgtgcgatggatggcgagctaaagaggataaagcgatgcttagggtggtgaaagaaaagagagaacgatgcctgatgcaggacttaaatcaaaaaaaacccagtctgtcgcaagctggtctgtctcatttgtgcggcttctttggaatgcaatctcctgtgataaggtcttatgggtcgatggcgaaattgctcctctcgccgtgcaaagtcatctctctggacgtggcgtcctttgtgctgacacccgtggctaatggtttgcccatcagctattctcttttattgttgttcgtttttgatcatcatcggagcgtcggtcttttccatccccagtcttttgaatttcatgttctgtgccctggacgattattttctcaagtgctgacacccgtggctattggtttgcccatcagctattctcttttattgttgttcgttttttaccatcatcggagcgtcggtcttttccatccccagtcttttgaatttcatgttctgtgccctggacaattattttctcaatttcatgtcacagcatgctgttggtatgtccatcagcaataaaacgatatattttcttccccaccataagcgtcttttctcagagtgcttgagaggtataaataccatgatcgaaaacactgtgaaacaggttcattattctcttctttttgctactcctccatcgaccttctcaagttgtcgttcaatgcgacagttcaacatgaggaggtgctcaggtacgacaagacaaacacaatctcatcatcgatatcgctttgctaccgacatagctcctcgcccgctatttcctcttgcctttacaatgctgaccagtccgtgatcatttctatacaccttcatgtcgcgtatcttgtatccacttctagcaagaaggagaaagaagaagcccccgtccggacgatggtctcacacccggcctgcttcgctccatcaccagctccaacaccatagtcaaccctatccttagtagcaccagttcttcacactggatcaatttctgctttcgacatcgatttgtatgccacgagagccccccgaccaagtcggggaataggaggtaaatttacatcttgtgcaaaaactgttatgctgaaaacgttcattacattatggtcacgtggacgtggactcctaaccgaatatttggctttatagacactatcttgagcagagatattagatcaggcactacttctgtatttgtatatatagttccaatccttccctcgtttatcaggtagactttgcctaccctattaaagatatctataacacacacaccctgatctcctcttgttgcattcctcgtcctcgcccaccttagtatcattcctcagctatcttaaagctgagcaagatcatggacaacaagaacgatcgtttcacaagccagaacttccgagtgaatttcaaaactcgcagaaagtggccattctaccctatgggactctccactggtgttgtcccacgaatgggagcaataccgaaatgctcagcttgccatctcaaaatcgatcatggcagtaaacgcttcatacgtaaagcggtaaaaagtggaacgatatggacccggatatgtttctatcactttcagctctcttttatcacccgagcgccggttgctggccatgactgaaattagtaacgctgaaaattaagagaccccctacatttctgctagaaagtgataagattccgccggactgaattttaaaatggtatgatgctttggttattggcgtcaagttgaggttaaaggtacatgtagaccgcccacccctgtcacagtatcgtagaatgctcttctacttcgccgttctcgcctctccgtaatcagaagctggagctccatcgccgtcattgtcatcgtccgatgacccctcgcggattcgcttcctcgatcagttgagaagcggtctccttctcatcacttgtccagcaggcactcgagctgggactggttctggaagagttgcggcaacgtaggaaaattgaccctgaggtcgtggcatctcgatctaaccaaagacctggcgagccgtattgaagcccacctttccaaagtaaaagtatcactttccaatgtgagacgattgacaaggatatcgcacccctactcgccgcttgcgctaatagaaagtaaaaaaataccctcgacaccgcccaagcatcgaaacctcctgtagagcatgtacagtagcaagtgttgccattgcgctcaataaactgattctttttctctttgaagactgcatcccatgcttagacagtgcgtcaataacgtctttgagagcttggactttcttctcaccagtcggcgtccatcttgctggactttcaactcacagctgtttggtacgtacatgtatcatgtcctccatgatataataataagcgttctgtagggcaaaaatcttatgccaacggcgatatgaatacgcctctaccatttgttcccacaacacgagctgcgtacgatgggcccacaagaaagcgcccttctgaagccgactgtgaccatggtgtgtaagaggctaaagggtatggctccctgcgtctttgcgtcatgtttttgcatatctctctaaaatgaagagtgcatttcaaccgcaactttgcatgttagtacctgtgaaagacagacctacttccacccggtctacattgaaggaggacttgtcatatccaatgacaacaatgaccatttggaggtattacgcaatgggatgtaagatggacaggctgtgttgtgactgtagagtaacgtaaatgcaggtattcattcattctgacgtttctcgtcgtcaaccatgcccgttgacaccgaggttgtggagtatgtgtatactctcgtaacatttcatgcttttgtaaacatccctccatggcagcaatggcagtcgtttcctgtgtatgcacatgaaatacgcgccaaggataatttcatgcaacagtggatttcagctagaagtgttttattgaggtgttatgaatacatagcgtatcatgtcgttttcgttggaggcatggcagcgggtatatcgacagaaatgacgtattcagtgggtatcctccactttaccgtcattgggacgcagttgggttttacataaaagcgcgttgcgaagaaagaaaaaaaatcgtttgttgcattctactctctagtctctctgcgttccctatctctctccgccttaccgtacgcaaaatcgttattcaatactgcacaaaatctcatctctacaaccttccacaacacatatcttgcccacacgttacacaaagccaaaatacatcagcactctcacgtttccttttcaattcttgcttaacctatggttgtctcacctaaggacaaaaaagacacactgacttcgagcggaaaggatatggatgaacctatcccggttgttgataccgaagaaggtcttgacgacgatgaagaataccgacctaaccccaaggtcgaagaggccatcgacgagccgctcgagtatcaggaggaggagaccactggcgatctctccaaaaataaggacttagagaaccccgaagaatccaagatggttgaagaagacgagcgcgaaatcgctggtggtggcctataagctgctacttccttgcataattttactctggctgagcactgataatcccattttgattggaaattattcagcaaaaaactgccacattctttgtattatggtattgcgcctgagtcgagcaatatgaaggctccttccagaccagggccaaatatatgtagtcgtcttttttgaaaatccggagaataaaaactaccagcgatggaaaaagaagtcaataaatgcacagggaccaagagtaaaaatcatcatcatgcggtggagtcagagggccaagtactcatgagtggtatcgacaactggcgggatatgcagtatatggttgccactcgcaaaaaccatatggcctgcaccggactaatcatttcattcttgggcatggacttcaatacgttctgaagtgcatcctgactgccatttcttaactacggctattgactttgctgggtcttaagagatatcaacaaaaaaaaaactggcagaaagaacaataccttctactgtacctggtgtttgcgagaaagaagtgttttctgaaatagtgaggacttttttggggtcgtagctgtcatctgagtttgccatgccttctgcagcatttagacctccaatcgctgacataacaaaactgctgcaatgtttcaactctcctttcacattgcgccatgagacggcatctgtgtgcaaggatgatgctcggaaagggtctagtccgacagtgtatgtgtctgttgtgcaacaattacatggttgttctcatgcaattgacttttattctgctcctaatcctgactttaacgacggtcatttcaagacactcagtattttccagttgtaaaggaaataatggcagtgagacgagcggggtggagagacaaggcttgcattttccttcaattgcagagaaggtggctggggaaggtatggaagacagctttcggctctgcacttttatttcctgggggaaaaaaacttccgtcatggtcaatcagcatcctagagatggggaggataccctcattcacttccccccattccctcaaccgggactccaccatctcacacatatgcatccaaggcagcaggaagcccattcacttacgtcacggcctactctcatcccgaacatggccaccttgcgatcccccctaataagaaccttaggagctgctctagaggcggcatgagcagcgttcgagccttcgcaggccgaaccggtacatagctaattcataacatacattgaaaaccagtaacgagacaagagagggatctttattctggcgggagtcggctatttaagtaggaaccgtctccctgcttgtacgtaggtgtccacacgtacatgtactcctcggcagaactgtagctaggctcggaactacagcaccagtgtccatgtcacacactgacaccacatcgtcgtcgtgtccggcccaggtaaaatatcggccatagagcgagcgaataagttcctgaggtgcgtttcgaaagatggcccgttcgcggtcttgctcaggttgatcgagcacgattatggtttccaatctccaagttggaaaggcactgtaaattgcgactgagtgtccgtcgcatattacaaatctctcatcggtaagaattaggtcagtggtcgcctgcatgtgaaatttgccatatcctaaggcactgtcgagacccttgcatttctggttgttattaaagaggctgagggatcctgaggacagaacgaccgatcctttcgcaaaggcattgtctctgtcgtattgataaagaataggcgcgttggatctgttacttatgtcccagctggaggagctcttcatgtctgaggtgtttgtcactgcgatctgcgatccattccaagagatggagacaaagaccttgcctcgcagtacctcttgcacctgcacatgtgcagagtgacggggagtgggtgacgcggactttgggcgtccgaggtctcctgtggttaaactcactggtgatctcaagtccaagatatcgagcactagttggctttgaatcgttgacaggataactgctgttgaaccgtctcctgagatcgcatagtcgcagactgatgggcagttcccgggcgtatctgtatcgtacaactcgccgatgttgatcgaccaatcgaaaggttttaactgcaagagcaaagcatctgcaaggctcgacgagtcaggaaaagtttgatcaaggccttcctcctacaagaattcgatcgaagcactcggaaaagttacatacctttggtgcgccgcgaggagatgcaaatatccatgtaattcatctcgaagtaaccaaccttggcttggacagattgagacgtctctattttcatggaaacgatggtccgctgtggcgcgctgccacgctcgagccgttggtgtagtctccactcttgaatgtccgaggactgtgcttcggtgttctttaaggcgtaccagtcccgtagagtctgcgcatccatggtctacaaaaaatatcacagttatcacagtttgcagagtcagtgtcgttagacatgggtgtctccgaggcgctacgttatcaagtctatcattgttgatatctgacatttacctcgctataccccaacaactgtccttcttccgtcatgaggttgaacgtgatagattccacttccgtatgtacaacgtccatcatcgagaatcctaggatgatatcaaagagttgtccagacttcgaactctcatcgacaagctcgaacatccactgcagtgggagtcaagcatttgaattgtactgtagtcagaaagagagcatgccgttcgatagcgtagatcttcaagacaatgtcaaaaaccaaacatacacttgtcaatccacccgaggcatcgactttcacaggaatctgtcgtctatatttcccatgatacgaaacgagttgagagaagtgaacgttgcgtgcgtcaaagccattgtatcgccgcaaaattggcgttgtcaatgccttactctgtcgtgcatataaactgcgccctatgcttttgatggttggcttgaggcgaggttttttctgcagagtttctctcaaagtaccatctgtgcattaaaggattatctgaagtgtgtgtacaggtctatgtaagaagctactatgaagcatggctttggagtaacgactttacaagatggcgtcgtaagtcttctacctttccttactgaagtggcatctctttctggagctttcatgcagagcagaatctacggtacatgcatgtacgatacaagacattattagatatcatgagtctcaatggtatggcacattaaccttccatttctgcacgacagtccgagcaacatgagtcatgccatagcgtctttaccacaactagtgttccaaggagaggtaacgacgtcttgcggagtacaccctaccgacggccttgcctcatggtctatcctatgatcggcaaaaagcctcggcgagatcgaggaccgaactagactcgtttggtatactgacggcaaactctttcaccgcgccacgatgtccaccgatcatgagcttgttctcctggtaaaagtgcactgtgctgaggggttgtatggtagtgaagtcttgacagtgaaacaaagagtagtcgagagaaattggtagagcagcaggagaatgagtaaaggaaagagaatgaggtgatggttgtgggattacactgaatgagcattcgcttcgaaggaaagagatgctcagatgctcattgactgttgactaccaagaggatggcaacacgagggagagtgagaaatgcaggggtgtaagggggcttgattgtaacagctattttgctgtgaattccaatgcaaacagggaataagcaatgtaactgcgcggttcgttccgcctggtggcaatgcttcaggtcccctttgaacctcggcccgcgttgtctaagcgaacgcgaaggtgagacattttgagttttgacgaatcctgggccgcaacgcacaggcccgttcgccctgaatgtgacaaggttattcctcacagtgctgcacctctcgaccatggcgcctgatcctcgtaatggatgcaaagacgctccgttccatcctcataaaaggtcaagcctgcgaggattaagaagatgcgtctgcgccaagcgacatggggccgataaaactttacttcttttatgatggacaccgcacaacaaaaccgaaactgacctggatcctccacaagagtgcgccaatgagtacagaccatatcaaggtgatcaggtggctggaatcccggaagctcacccttttacaaagacgcacatcatggacggtcataacgccacaagtttgccagtcagaccataatataaggtgtgcaaggttgtctccttttttccactcattcttcgtccccttcttttgctatagtaccttgtcctttgcaccatcgttgtcgcaacaggagttcgagtagagtctttttgaattggtagagatcaggacaagaacacagcagcgccattcaagaccagcatgctaccatttctcgggtgctcacgtcgatagataaatagagcaccccatctcttcgtttttaggagtcaactctcactcaaccttctctgaacatagtcaccatccctcgacatgctttgctattacactatgtagtcgatcatcatcctctgcatctttatctcctgtcactccgcacaggcaacctgcgaccagtgctcaacctacgaccactgaacgcttacatcgcccctcgacatttcaagatggagaagttgggggcgataacattctcgattcgaaaggacaactacatgatgtcgctcgacttgcaggacgcactccgccacatcctgatcaacaaaagatattcagaaagtaccctcagtttcgatggcggggcaagaaccattagttcaccagaaaaaagctcatgtcgatgctgattccgccaactgggtatatcggacagcgccagcgcgatgagcctgctagagaaatgttcagcagaccactgaattcgcatacggcgttggcccccgtcgtctggttaggatgtatggcccattctctccagctggtcatcaagttcaggatcaacagcggcccggagatcaagttgttgtcgaaaaaatgcaagaccctggcattagagttcagcaataagcactactggaccaatcctgcacaaggttcaggagcactcgtcaacaaagaatgatccagtggggacagttctcccagtgaaaacaagatggaatagcaagttcgacatgctggagcgactggttagcgtggtggcggaagtccttggtccattcaaggagctcactacttggttcagtggacgatcgtacgtggcggttcatcctgaggaacgtgaacagagtcttagggatatggcaaccattcatcggttaccacacgagagctggaagtcattcgctctacgagtgcagaaaaaggtcaacactggaagcgtcgcctatctcatgactcaccttctcagcccggtgcggtggaggaacacgatatcgctgtctccgcccagataccgaacaaggaattacacccacttgcgttccacaccgtcagcaactctatggtccatggtccctgtggtacagatcacctaaaggcagcaccgatcacaggagccaagcatgatgaccaaaccaaatggaagccgatcgtatcagcaaccggcatcctgcaacatccccagtcattgaccaagattcagaggaccgggaggaatcgccaacactcaatgtgatgaagcgagttgaatatcagggcaagaatgccctttttgttgaagagaatggaaggtcaagtaccatgggtcagccagaccatggccttctggggtctttgacaagatctaggcactcatagccgcgtctaggccggatcccgagtcagtcccatgctcttgtcaccgacttggtatttgtcatccatgtacacgcacaccattcgtctttatctcattttgttacttattcgtgtttctcgctcctcatggcagttctttttcagtatcaacagacactcgaagatatctttgaagacaatcctttcctctcatttgtacatagccattgcaacagtatatagatccgctatgctacagcagtatgactttactgtagtagtagtaggcagagccacaagatacggctaccgcagcgatcaagatactctgtactgaccattgagcacagacactagatcatagacacatatatatagagcatccctcccccctccaaatacggcagactttgccttcctttataaaatacatatacatcacatctccttgacttcctcttgttgcagccatccacagagaggttttactgatgtcttctttcttattctgtttgcaacattgagtggaattaacttataattaaagcaaccgagttccacggtcaggaatgttattcgatcaggcaacaatatggaggatccgacgaccgtgtcaaccttctgcgacatcttgtccaagtgtcttggaccggacaacttgcctgcagaacccaccagtggtataaccaacaagccctttatttccggaatacgatcggctgtgagaccgagtcgttctacgaggcgcaacatctgtcggcagacacgtcggggacgatgtttccgagtgcaacaattgcggaagaccaggtcgggccgttcatgcgtctgtcgttatagacatagagggatgcggtgcaatatcataacaacaaaaataaaaaataaaaaaactgactgggtttattagagctcggttcgattactacacaatggtatcataaaaggctggcaattcacttgggatggcaaaaaattgaatgataaaggagcgtgatcatatatcccctccacattatggatacgccccgcaaccttttgaacatgtgccagtactcatcgataccagtctgacggtttgttgcctgtattgcttcaatttgccccaaacattgcagtgtcacggaaaaagccctcaatcgagaattggcaaaagacaagggagatacgaccagagaaaagcccacgtcgcacatgaccatgaggtgggggtttgcagttcctcctagataaactcacgcgaagtgagcaatgtaactctacaaatccctagacattgcatgtaacttaaacacgccggccttagcactggggactgaaggctcaatgataacgacgtgttcttcgcttgcttgcttgcttgacaggaatatctcaatttttttcaaccgatggcagtggtatgagatatgggagtaggatagaattgaacgaagaaaaaaaaatggattcttggtcaatcggtccattgaaaaagatgtcaagatgagccttctagacagatcggacaagaaatatcacgcgtgtagtgctgggtgctatggggtcgttgagccttgctggagaaggagcgttctgcggacaaattgcttcagttccgagtctaaaaaaacttcttaataaaaagacgagactatttgagttggtttctgttgcgacccacgggtctttggctgcgctgatttcatctaatgcggatttgtgaagttccgtcgagccaaaacttacgcgcgccctccttccagccatggctgtctcactcaagaatgcagaagctgtaaaaccgaagcatcatcgaagcaaacgtcaaattagagcagctggctctgtaattcaagtagaaatataaaatgattgatcctctgacctttcccccctctccttctcttcatcacaacttcgtctcactcaaaagacgccccatttcaacacaggtaacttgtggtctctaccaactctcattgtccagaaatttcgttgtcaatgtgttacctcaaatgtctccttctcctcttcctcctcctcctccttctcctcatctacagtgtcttgccgtaatcttttaataacgtattattttttggattgcgtccctttatagccatgttgaagctagtgtccatcgtcctccttgcagcttctatcgtgggcaccgcgacagctactgcaaagcccaaaacaacgttgacatttgctgggacttgccatgggttgaaacagcagaaaaagtgtaacggcagtcgggcaagatgcctggtttactgttacgacagggacctcaaccatcgtagacagaagcagagaggcttcaaatggtactgcgacttttggagacaagaaatggattgggaagaggtttcggcgcatatgccccgtagtccatgttcgtctttacaggatgttttctaccacgaacagcttgactattaagacttcgggggaatgcaatcatgacttgccagagcggaaggaactctatataaaggtctacttttgataccacttgtgttaaacactttgcgagctgctcactctatgagacacccaacgatggatgcaacgagtgaagcaacccacttcgctcacggtccagagtgctccattcttaagtacggtctgcagtaagaaagaactctacctcgcgtccaatgccatgcaacgtggttctctatcgtcaacggccaaacaaataaccttgtgcatgctggattccgtaaaatgttttgtcttttgcagcagcacgcgtcgcgtgcttggttcctcgtgaacacttgcggcacatgatttgctgagaacgagagtggtttgcgccaccaaccttcttttttttcacactccatcaagcgatcccatttcacacttgaacacctgctccacctgcacacttgcttgcacacctccaccacacacacttacacacctacatcacacaccctcatacaccttcattacacgcacgcacacgcacgcacacccatggaacaccttcggaatctcccctccaagacagatgcattctccaccgcaagctacgagcgggtccgcgcagaccactcccacaaccgcccattcttcacaacccatggccaaaccccccatcaaggtgaaccactcaacttcaccgacctacacccttcttaccaacaccctcctcctccctcgacatggggctaatcctgaagtcctttctttttctacttttttttttttttttttttccaactcttcgttcacaaaaaaaaaaagtagtattaccaagcagcgacgaaaatctcgtcctggctgcgatccgcaagaagaagcaggcaagtgatatacaactttagcactgcacccatagtctgtgtgtgtgcatgtgtgtatgtgcatgcgtttgttggatggacccaacctctccctccatctcatccctccttctctcttttcagattccatcgtccatgcaagaccctttcaagcgacctccgaccgcggacgctgccaacgcacccgaagtaggcgcagcagacaaacagagccaaccaccacagccaccgcgcctcttcaaacggcccaggatagccctctccaatgcagcagcagcagcagcagcagcagctgtagcaacgccgtcttccatcccaccttcatcttcattatcctcatcagcagcaccacgctcaagtccgtaataaagaaagctgtattgaaaaccattaatcttgtctaatgtgtcttttttttgtagtagtagtgatccagaggcacggcatttgcaaaaagggcgcaagactgcatatcgtttcgttctatctatgccctggcccgcttgcggtactcatccccatcctcctcctcctcgtcctcctcctcgtcctcataatcatcgcctccaccagatccgcggccttggtcctcaaacaccgcgccgcggggatcaaattcctggccctgactctggcttgacgacgacgacgacagcttcagacccgtcacattgcgtgagaccacagacatgggcgatgcagacgctgatgtcgctccataatagctatccacctgcgtctggttgtggaatgcccgaggtgtcaaggtcgaggacgatccgcgctccctctccctctccttctcgcgttcccgctcccgctcacgatcacggcgataatcacgctcgcgttcacgttcacgttcccgatcccgatcccgacgatcgggcgaacgagaccgcacacgtttcttcatctccccatgacggtgcttcatagttgacgacgacgatcctttgtgtcccgatttccgtcggcgccgagcatggctgtccgagtcagagtccgatcctgacgatgacgatgacgacccagaatccgatccagacgaagaagacgacgatcccgaagaagacgatcctgaggacgaacttccagaggaccgtgacgaggacgagactgaacgctcacggcggtgacgcttcaccgatgaagacgacgacttgcgctggtggtgagacgaagccgagcccgaatacggccgcggtgaggtcttggagctgctggccccactgcctgtggctgacttgtggccaccaccgcccatcgccgcgccaagaccgctgctgctgctgctgctgcccttggactttttcttctccatgatcttgcgctgcagatactcgacctgcttgctcgccaacgccatcatctcgtccgtatcacttccactcgagccaccgaccttctcttcctcttcagcctcatctgcaaattctgcctctgtgggtcgcttcttctttgaatccttggccgccttcttaccactgccgcccgagggcatctttcccagtttgagcgtcagcttcaggccagacttcttcttgccactctcgccgttgtggtggtcatccccatccatctttgtcgctgacttgcgctccttggtcgagcttcggctcctcttcttgctgttgctggcgggactagcgggcgcgctctcgggatagtgctcctcatcccgataaagatcatgctcatgctcactccgatcagagtcgctcatcatctcctcctcatcctcgccgttcttcttgcggttcttgttcgccatcagcgaattgttcaaagccagctgcgccgcgtggttccggcgcttcttcttcgagacaggtttggggttgacgacaatgtcgatcaaatggtccatgcggcgcagaaccaccgcctccttcagccagacaaactcctcgggctccacaggagctgctggtgcaagtttgggtgccggagagggtgtcgccgaaagtccgcgctcctccgacttcaaatcggctgcctcggacaatgatcgctcgttctgcctatcgtcgtcgttctcggacttgatctccttggaattttcttcgaccgtggtgtccgctttctctcccaatccaacgtccgtcgccgcagacccatcagcgctgtcgacgaccattgcatcggcgggcgtctctggtacatggactccattaagctgaaccgtggggctctgatcgttctccacgacggccgtggggtctactttcataggtgcctgcgattctgaggagaggctttcgacagtcggatccacagtcatctcttcctttgctgattcctcagtcaagacaccctccatggtgttcgtagtcatagaggcaacagcgggagcggtgactgcggtcacttccctctcgaccttgatgtcctccacgtcagtcgcaacctggtccattgactcaaacttgttgacagctgcatcggaaagatgtccgtccaaatcctcggcgccggcacttggacccttgaccgccaccgagtcgatctccataggcccaccttgctcctcggtctttgtggcagcagcctccagcgcttccgcagcattcttctccttccgttcctgctgcagcgcttcataatgcttgctgatctctgcaaacggcaagtcctcgtcatcaacaatcagatcctgtcggttgatgccatgcttggccagaccctccaagaaggggcggtcatgaatgccaatcttccaccagctgggcagtccaggagacctgcgagaggcagcaagcagatcatcaagctagaaaacggtatggcatcgacagaaatgaggaaaaaaaaaataagcaaaagagcaaaagagcaaaagagcaatagagacagacggacaaagggtgcggaaaacggcagatgacagtttcaaacaacacaaggagcatgaaaaataataaaaagcagtttgacacgtaccatgggattcgtcaagatgtcgtctcgaataatgttcatgatatacaccctcttcaaaacccgcttggctctgtccagaggtggaacatcgcctcctgcatcgtcccgatcgtccttgtcctcatccttctcgtcgcgttccattgattcctcggcttcatgcttgtggtttgatgccagactggactcacgcgagtgtcggccaggctgggcattgtgcttgtccacgacctgctgacaaatcttcatgaaatgatgataatattcctccatcacttcatcgggcttcttgccaagaccagccaactccttgaatcgtgtccagtcgtgctgcaccaccatgttgagggcactgtgtcgcgaatgtctcttgctctgagagtttgaagagtggcccgggtggtatcctcccgcagacgaacgcgaggttcttccactgttgggcgtacctggcctcgaggagccgtttctcaagcgcaccactccaaacgacgtgattgtcttgtagaaatcgctcttgtccttcttggtccatctcgaggccagctcaatctccttctggtgcttcttctcctgcgccgcctcctcccgctgtcgctgacggtcaagacgcatccgctcctttgtcttgtccttttctacaaggttggatttccgaagctcgatctggttctgacgctggagcgcagacatgatcctccgaagacggagtccgatatcggactttgaaggccaaggcaaaacctcgtcatcgtcatcaacacctggacgactgtagctagagctcgcctgacgtgaacggcgagagctagagccctcaccgtcttcatcatcgttgccgtcattgttggcacgcaaatcaaacttgcgaccgtagaaacaaaactctggatccttgcgcacagcctcatactggggttccgtcaccagatagccatacttaatgatcgccagcatcaaatcccgatcctcatcgtcgccccaccaggatgcaggcggcactccagacacatgcgggataaccatttgcttggcaacctcccagtccttggggatcagattgcgaatggtgtggatcagctgaacacgtaggacgaggttgcgacctttcttacggacgtggtcaatgtattcctgagtggcattgagcaagaaagagcggtactcgatggttgccttcttgctcgccttctcgaacggaatgtcactggctgacgtgggtgcttcgtatccgctgacctgatcgctctctgccaagactacctccagctcgccaatcaacttttgatcatcatcagagccgttggacatgtccttcatgatctgctgaaccatacagtgcgcaaccgcgttgagatccttctctgttcgtcgagggaagaaggtccgcatctggtcccagcggccatatccgtagatcatcagcttgcgctcaaacatcaatttttctgccatgctccacggacggggtgcctctcgcttcctcgatgacggctctttcgcatccttgtcaccattggcctcctcaaagtctgggtccgagatataatccttgtcctcagaatccgagccatcctgctccttgccgaatctctgaacctgtcgtcggcttcggggcgcattgatgatcaagtggtccttggctgtgatctcctgaatgtcgacgttggcgcgctcagcccacttgtcccagaactgcgggtcattcacatccacctcctcaccgctgggcgttgacgagaacgtggctttggaaaacaccgaacccttttcgtttccagtgtggcgaatgacggtggtgcgtcgctccagaatttggtcgatatcttcctcacaaaacttggcgctcgtttcgtcgtcatccaacagggcaccgtacgctcccttcttgagcagttcctcaacctccttcttgcttagggacgagggtggcttgggcatatccgagagatcatccgagctgggcatcacgtccattttctgcagcacagccttatcaagtcccagcttgatgctggcacgatcaaacatttccttctcgtacgtgttcctggtgaccaatcgatagatctgaacgggcttggtctgtccgatacgatggcagcgagcggtcgcctgcaagtcgttctgtgggttccagtcgctgtcgaaaatgacgacagtgtcggcagccgtcaagttgataccaactcctcctgcgcgcgtacacagcaagaagacgaacgaatccggttgcgttgagaaccgatcaatggctgcctggcgcatatctccacggattgagccatcgatgcgctcgtaagggtaagcacgtcctcgaaggtagtcctgcagcagatccaaacacctggtcatttgcgagaaaatcagcaccttgtgtccaccttccttcaatttcttgagcagcttgtcgatcaagaccagttttcccgaggcctcgatcaagcactggtactgcgcctcagccgagacagcattcttctcggccacaatacggtcctcggcaccttggatcaagtatggatggatacagcacttgcgcagctccatcatcacgttgatcaagctgggtcctgccgacccgcccttcttcaagaaaccaaagttcttttccagaatcgcacggtagaacgccttttgagttgtcgtgagctcgacctcaatgatggtctcttccttgacaggaatcgacttttcgacatcctccttaaagcgacgcaacatcaaaggcttcaacagttgctgcagcctgtcgacctcggccgctgtcttcaagttgccatactctgccaaaaataccttctcattactaaaatattgcaaaggaaaaaaaaaaaaaaaaaaaaaaaaaaaaaaagagcgcgatcagattcaatggctcagtttcccagcggatcaacattcggcacagtctgaacaacacaaatcgcatgctctccttacacgaagcgattaggttccaaaaagttgagcaacgcaaagagctcatccaacgagttctggaggggagttcctgtcaagagaacacggtgctccaggctatacgttttgaggatctcagacaccttggatgcctatttaaagtgaaatatgcgatgtgttagatcaattaaaaactttgttccatcacagttcacgattttgaaatacataccgagtttttcaatctgtgagcttcgtcgacaacgatcgctctccatgcaataggcttgagctgcgcagacgaggccacaatctaattataatcgacaccgtcaagaacatgcgtgatgagtagtccgccatcagatgcaatgttcaaaaagtgcccacgaacgagcgaggactgagatacgttaccatctcataggtcgtgatcagaacgtcaaacttgtaaagaccgggaacaatctgaccctgagcgtccttgtaataaaactccgtgtcgaccagcaagttcctggatggcatatttccatgatacacaatcacgttcatatccgtccacgcctcgaactcgcggtgccaatgtgggatggtcgacaggggtgccacaacgagaaaaggaccgcggatgtggtatgtgttgtggatttcgttcaagaacgtcaccgactgaactgttttgccaagacccatctcgtccgccatgatacaagcctgctcattgaaccagcagtcaagcagccaattaagaccctccatctgatactgccgcagctgatttccgtgcttgaatttgggagactcctgcagtttgcggaaggcgccgcgaggtggacggggcaattgacgggctgcaacagcatctggaatgatcttgcgtgcataaaactcatggaccttggttgcatcgatctttaggatttcgtcccgcagctcccacgttgatccgtcgtacggcgtgttcttccactttaccaaaaaaaagatttggatctcgccatcgggtgttgccagctctccctcgtcaatgatgcgatcaacctaaggcacaaaataatgtgtgttagaagcaaaatcgtacgagtggcccaaagaggcggagttaggcagcgcaaaaaaggcgatcaagtataccagaacaaaggatgggttgaaaaactcataatccgactgttgtccatttttctccatgaattttttgacgcgattctttcccagatgctcgccgtcctcaatctttttccttggaacccattccacatgtaggtaactcgagaactagatattccagagaggaatgacacgcaaaagaaaaggacaggcgttagcttggatcctttccgcatctgcatacgtcatggcaccgatccgtgccattgcaaaagtgtcttgcattttcccttttgtatttttttccttaccttgaacttgattaaaagttcctctttgccctcgtgcaatctccaagccaagatcttctccaaggtcttgcttcccatggggacaagaacgggatcgtagggtactgcccagtgagctgcatttcctcctgtcttgcccgtcttctttttccttccaacggccttcttggctgcttttgtcatgggaggtggcgttttgcccttgaactccatgtcggactcttctgattcagactctgatccggcggaggaagaaccatcagcacccgagctcgaagatcctgagcctgatcccgaatccgagtcatcatcgcttcggaagtccgctgctgcagcggcagcaacaatggccttgccatgctgagccgaggctcttgctgcttgctttcgcgttgctcctgcgggagccggcttggatgctccacgtcctcgggttgacgtctgtcgagcagaattggcggcggcctgtgcgggcggtgctggggccagagccatgggtgctcctgccatggtcgttggaccgttcaaggagaactgctggttgagatgagccggcagctgactgtacgaattgtgactcagggctggttgaatgtggggctggtactggtgctgatgctgctgctgttgatgttgctgtagctggtgctggggtggcattggctgtgtacgagccatgatatgggcatgctgttgagcctgagtttttgcctgcagctggacgtgcgcctgagcctgcgcctgtgcctgtgcctgcgcctgagctcttgcctgtgcctgagcctgttgacgggccaactcctgctgctgtctgaccagttcatgctgctgggcctgtgccagagccaaagcctgtgcttgagcctgagcctgcgcctgctgaacttggacgtgctgaacctgagcagaggacattggtggcgaggtaagcggcgacgtgagatgaggcgagtccatggcaaacgtggtcgcaggctcaaactgcatggactggctgtacgcgattgtggggctcgtgtactggacagcggcggcgtaaccatagtgctgagtttgtggttgtggctgctgctgttgcggtggctgtgactgtggctgctgtggcccctgggcttgcgtctgaggctgctgctgctgttgctgcaggtagagctgctgctgctgatattggtactgctgctgttgctgctgctgctgctgcaaaagatactgctgctgctggggtgtaagattactcgactgcaggtcgatctggggcgacatctgatgcgctagatgctgctgcgattgctgctgtggctgttgtgagtggtggtgggcggcatgcatctgatgcagctggggcgagacgacctgctggtgcatgggcatgtgcgcatatccttgctgctgcaagtgcaactgctgctgctgtccctgttgtggctgcatctgttgatggcccgagtgctgctgctgctgctgctgttgttgttgttgttgctgttgctgctgctgcatcaggagcgcctaagagacatgaaaacaaagagagtctgtgagaaggagatggggagtctgtttgtttttttttgtttttttttggtggcaaaaaggcgtattatcgtcctgttgctgcatgtcggcaggacaggctgtgcaaggaacgagccgttgttgcacaagcgcaacagggacagcctatcaatctacaagtgcatgtgcagcaagaacaggagactgggcaggcacagtcgaacaagcttgctgcaagaacatcgataggcctgcgttgtctgtgtgtgtctgtatgccagccagtgggcttgtgatcagcatcgctcacctggtagttgtagttgggatccatctctgactgatgcgccgacccgagggggaagggagctgtgtcgaaagggggcttggatctgtcgctccgtgcaggaggggtcgcttggagcgggcgttgagatcaaacgatgagctgctgtcccctgtgcttgctgtggtgcgtgtgctttccctggaaaggtgtcagacaggaatcaagggagaatgatgagtctcgatgcgatgcaggatccgagtgcagggagagtgtggggagtgcaggtgcaggcgggcgggatcacggacgaagcgatggagtgattacgtgaggcgctggcactgtcgcagccaaacgaccgatgaacagatgcagactgcttgctgggtggattggggaataggggaatagagcgagagaaagagagcgagagagagagagagagagagagagagagaagaagagagagagagtaggacgggaagtaaagggaaggaaagggagagaggacgggaaggagacgcacacgtggaggacaacgaacacgtgtacatatgcccagccacgagagccgagcaagaccttatgtggacgacggcagtggatcgcatccatgagtggggccgaacagccacagcacggcacaaccaagaacgcaaaaagcagtgggagcggaagggtggacgacggccgaccgcaagagcctggaacaaacccaacgtgcaaaactgcacggtggccctcaagcaatgcatcaagtggccaatccagagcgacggacaatggacactaaacagtgaagacccgtggacggtatacagcatttaccgcggactcgtgccagaagcattggtcgcagcgtggcaaggactgttccgaaactcaacaacagcaatcgcaaggagcgttgtacgcaagttttgccgattcatcgaggatgaggcaaggaagacactttggacccctcgttgcaagagcacgatagagtgggagaccagccgcggtatcaccagccgcaagaagggtgcacgacaagcagcgggagcgcgtctatccttcaagccaacgtatggacgagtgatccaagacgacgagtgccagtgcgggcaaaagctccaagaccacacggacaaccaatgcccgggagagcagaacgacccacgcatcgcggatcaggcgatcattgacagctttacgggccagaggcaccttggaataatggagaggagaggaaaaatggttatcaagtcgttcgaggaggaataagacaccttgaaccgccccgcgacgggcagcaagggtcatctggagttaagcgcagagctctgagagctctggcgcagaggacagagggcatctcctcagctgggtgtagtctgtagaacacatatagagtgcacaccacgagctatgctagacttccaattcggattaaacttgacgatcaaaaaaaaaacatgcattcggatcgaggtttcagagtgtggagaatggcgtgaagcaatcgagatgacgattggagatcttgacgccatgagtagccgaatcgacccgtttgccaagatgagggacctttgatcgtggcaaatcttgccgatttgtgaatttggccggacgagcgattcaagcggcccggacgaaagcctggctctggacaagccaactataccggcagcactgcctacggaccattcttgcactagtcgacgagcatgcgcaagcatcggggtctgatcggccaatgaaaggcgccgaatgggatatgtggatgatccatatgggcccatatgaaggtgctagggctcatagtagagccgtagtacaaaaagtgctggtgcctgaatccggtttttaaggttttcgtgctatgcccgtgcagcaattcgctgcaaaaccaccttgcaggctgtatattacgccaaagagtcgtcgtggaccgtcagcgctgctaccaaaagcgacaacgagccatcataggtcctagagcttaataagctctctagcgcatataagggcacctatgcgtgtctttcgcaggcgagtttgctaatgcagtttttggagaatgtttattccaatcacttttcacagggtttgcgagtgtgcccattcgcgtgaggcactgctttcaacggttgctcatcttgaccatccgagttgcggattcggcccaaactccaaagagaaaaggtcgattcacgaactcgagtcttgcacatttaggaaacctgttatgattgcgaatcaagcggctcagacgaaagccttggctctggagaagccaaccatgccggcagcatcgagatataatcgtttatacaccgctttatacaatgttgaagaccattcgcaagaaccgcccatgatcggccaatgagaagcgtcggatggggtgtatgtatggctactatgggccataggaacataccagggtcatagtagggccatagtagaaaaacacctatgcctgaattccattttattaggttttcggcctctgcccgtgcaataaagcgctgcaaaaccaccgtgcggcatgtataatacgccaaagagtcctcacagacggctggcggtggtattaagagcgccaggtcgccatcgaaagcccttgacgcctcgcagcactatattacagactgagacagcagtgcacacctttcggaggcggctctgctaatgcagctcttgtcgcctgctcagtgcaaacacttctcccgaggtttgagagtgtcctgattgacgcgaggcactattttcagcgattgctcatcttgaccatccgagttgcggaatcgagctgctcttcaaaggcagaaagatgatgaacgggtgcgaaaatgaccaaactcacagaaacttttacaatgtgtatcttaagtccgtgggagaaagcgctcgctcgggagaagccagccgtaccagcagcatcgaattatcattgtttttgcaccggcaacgaccatttgcaagaaccagcgctgatcaaagacaggaagacgatgagcgggtgcgaataggaccaaattcgcggaaacttttacaatgtgtatattaagcgcatgggactaagctctcgctcgggagcagccaacgataccagcagcatcgaatcataatcgtttttgcaccggcaacgaccatttgcgagaaccagccccgatagaaggtatataggcgctggtaccctggatactacctgcttcaggttctctcttataaattcattataatgtatatcaagcggatagggcgaaagccctcgctttcgagaagccaacgatgccgttagcaccgaaatataatcatttttgcactgtcgacggtcatttgcaagaactggccctgattgaaggtgtatgggcgctggcaccctggtatctattagtttaaggtttttgcgctgtgacactgagataaaacgctgcagaaacaccgtgcgacgcgctatcaagtcgtgcagtccgcattgagtgcctggcgttgccacccagggagccacctacccatgttgagctctagagtactctccagcactctcgttcatagcgatctagcgtcagctgaccccaacttcagacggcgacttgcctaatgagaatgttgcagaatgatcttcaatctgcattcgcatcgaggcttcagagtgtggagagtggcgtcaggcagtttatatacatattggcgatcttgaccatgcgagtagccgaatcgacccattcaccttggggagaggcctttggcccatggcgacatggcgaattcagcagatttatgaatttggtcggacaagcgattcaagcagcggggacgaaagcccttgctctggggaggccaacgatgccggtagcatcgcattatcatgactttggccctaggtagcggccatgcgcaagctctcttcggccaaagcgccggatcagaaacgtgtcgaggaacgagtagaacctgcttgcgcacatgctcaagtggtgtcctatcaacctcctgttagctactggcgatgctacagcttacaagttcaaacgtgcctgttcacactggggtatcatatgtttcatttatagttatctccattcctctggccattaaaagtagtcttcagcgtggatgaattcttcaccgagcgtgatgaagcgcaggttggcgttgaaggctgaaggctgcaaccgtacgaaacgcgcttttgcgtgcagccaatgggctggcggagaattccaggggtctgagcataaaaagaatggctgggctgacccgttcgctcaagctcatttcctgtaaactcttctccacatctcacttgagctaactcgactccggcttcaaaaagccatgcctccacctccacctccacctcctccacccccaccaggcggtgcatcattcgtcctaagtgctgccacgccttccacagaacgcagtgcgctactttctcaaattcaaggaggcgcaaggctcaagaaagctgtcaccaatgaccggtctgctcctgccgtcggtgagtagccagctgtcagttcgattgggacttacgcttgtctggttcccaaaaatgatagcggtatagcactactaatagctatattgcaccatcgaatctatatgacagagacatcaaagtcaagcgcaagcacaggtggcagtggtttgccacgaccacctccagttgggggcgggggcgttgatggtgatgttcctcaattaggagggctgttcgcaggcggcatgcccaaactgaagagtcgagctggcggcgtagacacagaaggtaaggtagaatggagaaggttccgcagattcgcacgggacaatgaggcagggaggccacggtattacatcgctacgcggtcaagagtggccgtattcgaacacaacctaaaggtcacgtcagactgttcccattcgccgtgaggatgcatccattgcgctggaaaaggagtcatcacgggtcgtccatccgtctcctttatctatgcgtacagtagtgcacatcatcgagggtggacaatagggatggcgggtgaccaggccgttccccggcaacgtgcaagtgcacaaacgcatgaatgtcccaaatacgccttgtctcatccctcgcttcctgtttctccatctccgtagcagaccgtggcacaggcgcaacaactgcagctccaccaagcctactcaatcgaagttcgccctcgacatctataccagcttcacctccagtcattggatctagcacgaccaacggctcgccagcccgcacagtcccagcacccccactcccacctggacgttctctcgcggcagcccctccagttccttcacgttcgcctgcaccgcccaccccaccccgaaaggcagcacctccaccaccaccgagaatcagcggagcatcctcgcctgcaacactttcaaaatcaattccagaaccacctacccgtaccccgccgccgcagcctagtcgggcttcgcccgcaccaccttcgccggtttcgcctttgccgcatgggtccgctccatcatcatcaccaagtaggacgcgtgcaccgcccagtatccccctgccaggaggaggtggtgctcgtcccaggtcaggatcaacaccgcagcattcaaatcttcggcccatgtctcccgtcgcaacgaatatgagaggtatgtagcaatgacaatacgatgtcatttgatatgaccagacgagttgttgtactttactttaacactctccacccctttttcctgaccctcagttgaacctccggcgacagagggccgttggacttttcgatcagctgtcgattttcctgcgcctcctcgatttgacaaccaaacaaagatctattcgagcgggagcacatctggaagctgtaagtgataacaccacattggacttaattgcaggagagcccgcgggacgttcaagttttgggttttcctaggctgacctgtaagctcataaattacttttgcgggatcctacttagctattccaatggacctttcatctctggcaggactatcagcaggaagagcgccgcctcccccgcctgttgtaggcggcggtcgctaccgatgagactgttcgtaacattaaaaaaaagaaacagctgtacaatatgagagttgcaaaaagccctttattcgatttttccaagagcctggcccattttaaccctttgaccgggttcgatcaagaacttgaagttcttgggcgcctcgaagactaatacaacggttgatcccagcttgaaaccacccatctcctcgccaacgtgcaatggctgaccgttcaacagacggctcacgccgctgtacaacagttcgccaaagccacgcgtgtatctagactcccgctggttcgtgcgcagttcctattaacgcattattgtttaggtcagttagtcaaactaatgtcttttcaggtgcatgcaaacaaatgattccaagagattgtgagggaaaagtagacataccttgtcgaagttcaaaacgatgcttccgacattggtggcaccgactggaaccatagaaaagaatccgtgtcgccactttccaagcaaggcaacacgctcgttcaacacaaacaaatcctgcagctgcttgaccatccaaggtgaaaccgagtacagttctccggcgaaatgacgtctggtctcggcaacccagttggtgggcgagtggaatcgatggtagtctccgggagcaagataaataacgcaaaagaagagggcgtttccggggcgaagcttcagctcctcctgattttgaggcgatcgtgatctctcgtcggcttccttatcggggacgacatttccgtcataatcctgcttcttgtgctctactgaggtctggtcttcatagcccaaaaggctgtcgagcgtatagctgattccgttcacctctgcaaactcttcctcgtccacgatattggcagagtgggtcgatttgatgatctcggccgtctcacttgctttctgagagcccaaaaactgatccaatgaataggacatgcccttgatctgctccaccttggagccgtcaacgagtccgaaatggaaaattcgtccatccgcaggcgacacctaatggcaggcggatgttcatgaacaggacaggggcgtgagtgagtggcagttggtaaactgtatgacagctttaagcgcgtcactgagcggttggatatttacaagggcggcatcgtagtctacaggtcgagcgccatcctttagctcacggtagaagaactcgcttaggttcttgtagtgggtcaaatcgggatccttcatttcatccaagttgcaaccaaaaatccagctgtacagtttgaagccgggcgtgcggaaccacatgggcagagtgatactgttgaatgctccccaaagtcttgatatcgttctcaatggtagctcgctgatcacatggacctacattcgcccaagatgcagagagcagccaagaaatgttagcaagaaagcactagccaacaaaacattatgcaataaggcgaaagcaaggatcacttccgtcttgctcacggctagcaggtgacgtacatgccatggtccaacgatgaccgccttcgtaacattgttttcccggtcggcttcacgctgcatgatcttgcgatactgcaagaaagtaatgaaggcgagtcccagcccaatgggaattggggaccacttgataggggtgtccttccaagctttcttcacgcgacctaaaagtcgaagcgagtagctatcagtatctcgtcatgctcgatgacaatctcattagcatatatgcggtgctatcccttcaaagtctgctgaggtcttactggcataggtcccctgcttggtgttggcagcagactcttgcgaggtgaggcaagacctggagacatggaagttgcgctgaaccaaccatgcgggacggcatggcaccctgttaagtggagatgaggtcgagtggccaattccgcgtagaatgaccctcgagaggggcatcattggtcggtgcatgttgatgtgtgcttgggcgagtcaagcaagacgtgtgctcggcgtctctattgcgcgaaagacccacccggcggtcggttgtggcgcagcctcataaacaggactcacaaaacccaaaaaaacctgtgactggcaacaacctatccgttatggcctttttgggtccttcgcgggacgagcactccgaaggacaaaaagaacagcgctgtcgaccttcattccacctgctttcaaagcactcccccatcagaacttgttcctcaacccaatggccacaggagtcttcagagctgcgtccctacagtggagtggcaggtcatttcgtgcggatgttgcacccaggatcaggaccatgctcactggtcaagcactgccaaagcgcctgtccacggcttcaacacaatggcagcgcaccctccggcctgtgctgtgcagctccttccattcatcccacagcaggcgtggagcagaaacaggtgcgtagtgaacctgcacataattttgcgttgatatcttttgaccaaatgccggatctcctagactgacacttttctttgttcctgcaaaagacgcggccgcgataaagcagcctcccaagatcacatcggagagcatcaccgtcggtggcaagacctacgctacagataccttcacgaacgttacgcccaccattctcgagaagaccacgcgacagctgcacctcatccccagtcatcccatcgcgattatcaaggacctgatttcggcttccttccccgactttaagcattacgacaaattctctcccgtcgttacgactaaggagaactttgacgacctctgcttctctgatgaccaccccggtcgagcagtgacggatacatactacctcaatgagaagatcatgctgcgaacgcacacctctgctcaccaacttcaggtcatgaccgaatccgacaagttactcgttacagccgatgtgtacaggagagacgagatcgatgctagccactacccagtcttccatcagatggaaggtgctcaactctttgataccaagacagctgtcgaggatatccgcaaatccatcgctgcggatctggcgtcctccggcgcttctggatcgatcaacaccacggacacgaccgtgatcacgcccgagaacccgaagcaggattgtcatgatgaggcggccatgttggcggtggcggatcatttgaagcactcgctcaacatgatggtcaggcggcttttcgcgcatgaaaaggacttgcaggtgcgatggatcgaagctcagtttccgttcacgagccccagttgggagatggagattttgtatcagggcaagtggctcgaggttcttggaagtggtgtcatcaagcaggatatcttgaagaacgcgggtaaattgaattgttcaaggtcattcggaggaaacgcggttcatcttttttgttttcgctgtcaactttttcttctttttatctatggaagctaacgtcgcaagtataaatgttcgcgtcatactaggtaaaccggacaagattggttgggctttcggtctcggtctcgagagattggcattggtgctctttggcatcccagatattcgccttttctggtctcaggacgagcgattcctgcgccagtttgaaccctcccagattcaaaagttcaagccattctcaaagtaccccgcttgcatcaaggatatatccttctggtcgaacgagaactttcacgaaaacaacttttgtgagattgtgagagatgtagcgggtgacattgcggaggacgttcagttggtaagaaacgcgactttggcttccatttcttgagatctggctgtgctctttgaccacgtctcactgaccgtccctgttttcttttgtgttcaacctgatgtgatcaatcaagctcgatgaatttgtccatcccaagaccaagaagcgcagtgtttgctacaggatcaactaccgatccatggatcgtaacgttacaaacgtggaaatcaacgagattcaagagaagctgcgagaggaggttgtcaagcgcttgaaggttgagctgcgatgaaaagattgcaacacaacctggagaataaaccaagactatcatttagagtaaccccggctcagcatctaggatgtctagtctcattacaagcgacgcggtatttgagggtgaggacgtcgtggatccagtgaccctgaggcaacgggattgaagggcattgaataagtgcccggaaaacgaagctgttgttgtagctgttggacgcgctggaattgctgtctttggccgtgaacttgctgttgtaaatggccttgttgttgctgttgctgttgctgttgctgttgctgttgctgttgctgttgctgttgctgttgctgttgctgttgctgttgctgttgctgttgctgttgctgttgttgctgttgttgttgctgctgctgctgctgctgctgctgccaggtagttctgacagatgacgccgtgttgttatgtgtatggatccagctgccttttaccaatagtccactgctgggcactactctgtggtgaccaggagcttggccgacagatccgatgattcggggtgcatactgcccggccaaaggacgatacgacaagcctcctggtgtgggggctggaatttgatttgagataaatgcctgagatgccttaggtgcctgagatgcctgggacttgccggagtaactggggtgcatagcttgctcagtcggcacattcggtggtacgggcccaggcagtggtgtcttttggctcatatggcctatataagctgcagttctaggatactggctcgaggtggatgcatgtatactcggagccattgccgagtgcgtcataggataggaaaccgtcggatggctaacttgcgctgtaggcagtaatctccggtgggctagtgtatgggacgacacactgagaatctcactcggatgcctagaaagagggcacggtgaactcatgagagatagtcgtgcgggaggtgcaggagtcttttgcgacttgataagaattataagggtcactatcagttgctggctcctgggttaaataacggctgcctgcttggtcgaacgttaaacctacagttggaggcgctctggcatggcttgcgttggaaattatggattgcgctctactgcccatccatgcgggcgttagtcttcacgaacactttgtgattttaaagtgcttcacaagagctttcgctgtcattgtacctgtcctcaaacgcggtgctgattttcttttgatgctgcgtgtcttgggcgttgtgtccttgttccgctgcctttggctggtgtccgtgcacggttttggtccgcgactgaccggaaggttgagtttggcgatgctgcctttgtaccccaggtcctcttccggattgcgactgcagggttggacgctccgtgcaacgatcttgttcctttatcatagctttcaggcgtatgttctctgcggtcagctcctccagtcccctatgatatggcagtagcgttattcatgaggcaacctgtcctcgaccttatatactgcaccgcacgcttctatttacgtcttcgtttcctcctttctttgcagctccttgagggccttcttgagtaatccactttgacgctccgtcttgcttctcaagtgatcaattaggctgtacatattgtcctcttggaactaatcggatagtcggacttgcttataggtcattgctggctcagtggatcaggtcgccatcaagcgctgtatttgaagcatagtgtcattaccttgctagcatccaacagaacacgacagagttcttgtaacgactgaaagtatggctggatttgtggaggaagttttgtctatgggagcgacgttaatcatctctcagctccaatcgaaagggcacgctatgctcatgcaggcatcaccgttcgcataccacgtcctttgggacctttatgcaggcgcatgttgccttacacacagggcacactgtatccaggtcatctaaagttggtggcaaaaaaattggcagttgttctctgaaatttgcaagggtggttcagcaaacgatggcgcccataccattacgagtctggggttctgacgcttcaagatcaatcggtgcacttgcgcctttgccagtagcatttgctttgttcctggtagctgaacagcctctttccgcgcatttctgacaaaggatatgcccacagtccgagagccaatactgagactcggctacaggctcgtctcgaaaacatttgttgcagtggaggtatctgagtacttgtagtgtctgtgctgggcgcattgaagtcattttgaaggcagagagagaaagagaaagagggaaggggagaggaaggggaaaacgaagaactgattttcgacgaaacttgatagcttaaaaaaatcgatcctttacacaacgcactcagtttcaaagcaaatttattcacaggtccttgcctcttgccaaaggcgaaggagtaacgggcgcatgctgtcgagctccctcaccaccgcttgccccactgcgcccatacgacgatcgtagctgtcggtccgcgcgacgatcgctgctatcacgagccctactcagcagacttttggccgccggtgacagcatctctgcttttgctcgagggttaggactagccatacggcccgaccgcgttcccgatgcatccgggccattcttatgtgtcgatggcgaaactgctgaataaggcgaattgaaacgaggcgtgggcgttgtaccaccaaaggcagattggtacagggctagcgcggaggatgaaggtgtggaaaacactttagatcgcaagctcgagccctctctgaagctcttcgaggctttctcagagagcttctgagcaatcagctcgcgtcgaggggtgggaggtaatttgaaaggcgatggacctagtgcggaggatcgacatttaacaaatgaggttagcacctgttttttttttcatctcccacgttgactttgcctacattttgcattctgccgagaaacttactcgatgagtctatgccggagctgataagtaatggttcgtcctcgatagttccccatgtcatcatttctggatcgtcccccatctgcgacatactgggcgacggtgttgaagaaacgaagccgtatcctgcaactttgggcgagtcagttgcttgccccttcatatctaatggaagtagcagttagaatagtagcggtgagtacccgcaatgagcagcttgaagtgtaaagaggcatcaacgcggcaaagcaacatacagggtgccggatcaaactttgaggctgccgcctgattcacgaccagtaggtcctggccttgaaatccggtattcttgtgcaaaatctccttggggtttccacgaatcgccttttcgtccagttgggtgcccaacccttccggaaaatacatcaggctattcttggcctattacagtagtccttggttagcagcgacacctctgaatactgaataatacgatgtgattgcctacactcacggctcaccttgtagtcccatgttgggatgatcccagactttttctcggctatgactagactcatctttgcctcagccgcgaccatagctctgtcgttgtcctctcctgtttgacgcagcaacaactgctctgaattacggccgccttctattagcttctgactctggttttcctgatcgtacatccagcgaaacttttcctttttcctggcattgatcttctcgacgatctcgttaaacgaagcattgtcctcgctcgtgtatcgtgcttgaaactggtcgagcgtcaaagatgtgtcgatattgtctgtcgtcatgaccgctctagacgttgaactctttattccaagagtgctttccgaaggagtttcggacatcattgcggctgttcgctgtaatggagttccagaggtattgcggtcgtcctgccatgttggagtggtatcactgatatcaacacgggccggcgtccatgcttcgtttggtagtcctgattgtgcgtatttaggggttcgtgctgagcatgtatcaaggaagcagggttaatccagcagttgggttgctatgacatgtatacaatgcccaacgtagcttggcgttgcattcagaaaaccgacctggtgttttgagtcgtctttgcgaccaaggcgtgtcgtttccagccagctccttggccgcagcttgtatcctctcggtatcgttcatttccacagcgtccagataggcatgctgccgctttagcttggccaagtctgggaagaagtcgcgctcaatgatcttgctgagggcctcaatgtactcatcctcttcaagcacctgctggggcgcgggagtgggtatattggacttgtagactggctttccagttctagtgctggggaccagtgagtctgatgcggcggcgggtggtgagggatcggctttcctgtttgcagccttgattagggcgtttgaggacattgcgagcaaagacaaaagaggtggtttgccgccctgtctgaaacgggcgtggttttgcgtacaaatgtgtggctgggattgaaagggtttgaagtgtgcagtttgggaacatggatgtatttcaaacagtcggacatctttcccttcgctcgcgaattccgttcctggccaccgatcccgtccttcgcatcgacctcctccatccatcccccttcagcccagcccagtctcgctctccaggcccgttaccgaggtcgcctattctacacacgccctgaaagaccccccccccccccggcacccctcgtcttgctgctgcacccgtgagcttgcccgagaccgccaagaccgtttccaccgccgcagacacaacgcatcgcttggccgctgggcatccctgcgtcctctcccctcccatgcccgacaacaggagcgagcactcggtaggagaacagggccctctctcagtgtctgcccatgttgttgaaccatccgccctccgcctcccaccaaccgttacatccaatatcatttatcaatttccgcccatcaaacgttcctcgtccaaaaacaacaagaaaaaactatatttctggtttttcctcgcctgtcgttgtcgttgtgtccctgagttcctttccacattgtcctttccacttcgttcttcaacaccgctgcccacacagctccacacacacacacacacacacacacactgtactgttattcctcattcatcttgctgcttcttcccgtcatcttcacattcctaatcagcccatcgtcccatctcgcttttttgatttagcaactatcgctcgtacccggtcagcagtacgaccagggtcaatcgtcgaatatgcgccagcaattgcatcacggccaggaacagggtcatcctctgcaatccaactacgacgatccctccagatacccatcaacaccccaagacaaccaaagcagtaaccacatgtacaatacccaccccaacggatacgttaataccaatcacaatggccaatactatgcctctcccaatcagctcgagcagcttcagcttcagaagcagcatcagcagcgtcttgaggagaacatccaagcagaggacactctcaggatgcagcagcatcgagtcgccaggcccaatgcggccgcctccgtgcaagattcacgggtttctgagaacaaaccgcccaactattatgcataccctcctcaacccaacgcatcctcgacctcactcgatcaaacaggggacgtctctttcaaggcccacttcacaaagcttttctcgttcccatgctccacctatggcaaggccctgatgcttgtgattgctctagaggctctccttgtcattatcatacagaccgtgattgtggtcaaatacttcgatgcgctcagagacacgcctattatcgacgacagctccgatccacagccgccacatctcgacaaaaacaatacctctcgctcgattcccgcctacctgatcgtatttgtctttgctcaactcttccagcttgtccttgcgtgggatgctgtaagtagtgctgttcgactccttttgtctgccatcctgtttacgtctacgctcttgagctttttcccctttattttgcgctgcttcgtcctttggcagctgaagaggtccagaggatgaaatatgttgcggctgcatctcctactttcctacctttcactctgactctgctttgatggcaaagctctcgccacggccctgctagtcttggatattctacccaatgcaacccatcgattccacttgacagaaagagcagaaccgagaacgtatttcagcactgtgcatccttgtacttacatccacctttctgactatgataggttcgcgctcagaacacaattgaaatcatcggcattgtgattttcaacacctgctgcttcgcctacgcgatctttgaagtcagtcaaaacaacaggtctcttacgtacagcgccaaattctttgttcctgcgggagcagccctcgaacttattgatgccttactaccgttcctgatcgtggtcattgtggtcattggcctcactcagtgtatcgtaacgtggctggcgtaccagctcttccaggagtttgggtggaaaatctacaagaaaattggtgcggaccccaacatgaagagtaagcaaaagatcgctgcgactgctccttgaaatctcgctttctatgattcttgatggtcgaagctaactcaacgctcctgcggggtggtatcttggttttgtctcatagagatgtaccgtgcgtaccagatttacttggttctcatcaaagtggatgtgttcttttttgttggattttcaatccagttcatctatttgacgcttttcaagcgttctgccgacccggaatactggatcacaatcatggtgctgccgctcaccatcgtcatcctctacattgcggtctatgccgtccgacatgagagccggaagtggatgatcacgttcctcgtcgcgatgcactgcggcgttctctacttcgtgttcaaggtcgtccgcatgtacgtgggagacagagtccagaactaccaaggtgttaggaactttttgatgctttttggtaagtcagtccggttttcaagtatgtattggccagactaggcggagatgatgggctgtatttgacacatcttttttcttcctaccgataattcctcttaacagccacgctatgcttgatgaccatcctggcgacaattgccaacgcagctgtttgctaccggaattttggcaaggggctgaaggcccatctgttgaaggactcgaggggatccggtgccgcgacttcatcgaccagcgggcgggtactggaaatcgactaagcatactacaccacttatacaccattttaaaattaataaaatttcgggttcacttcctcaccttcttacatcatgcaaacccaagaacaagaccacgattcagcttacgaggttggccaggaacagcttgatgcagttgacaggatgctagacgagctagatctggaggaaagctttgatcgaggtaaagtcttgccctggagtgtgaagtggcgcgcattttgcatgcgcagagcgaggagacggaatctagcagtacctcacaactgtcattgacgtataaacatcctcgcgacctagatgctcattagtcccagctgcatttcggatcgtcgagcgattcgagcaacaacgccaacaacaggagtttaccaacggccttcaggatggcgccatgaccaacggacacagcgaacacctgcaacaccatcacagtctagaaagcaacgaggagttcgaagctgaaggttattcacagtgtcaagaagacgatgactcggactctgaagagccgttcggctatatcccactggatcaaggtggtgatgatggggacgaggacgaacatgatgaacagggtctgggtgacggcgacctcgaagataacaatggatacttgaggatgcgggacggcgatacagatatgggtgacgatggcgataataacgatgaatacgacgacgggcaaggatatgatggctatcttcgatcgcggaatcgtgacgggacagcgccagtgcctgtgattcctagctccgtgcagatcgatctagctgaacaggatggtggagctgcagagcaaattcctgaagaggatttgaagacgattgcacaggtcatgagctcgttctcgctgccggccccggattgggcgcggtctatacctgaggagcgatggctgcccaagattgtgcagcaagctgaagcggctgccgttagccctgcggatgctcccttgccgtcccgtgaggctagcagtgggagtacggaacggtcgtagttctgatagtcaagcgaatacatacgcgccccgttggcctggttgcctgtccacatggcaaaacgtcataacatatgtttgtctgtgcctgttggctgctctctctccgacaactatatcgggcagaaaggagcatccggcagagttcttgtgtgcggtggacgggttgcggttcccaaatctgggtgttgattttgccggatttccgttctcaaagaaccttcttgccccctaacttttgtgctgttcctgtttgaaaaaaaagggtgtaccgtttgttgtaacctgaacaaccgggagtgcgctattatcgttttcatggttgggaagccattgtcttggcagcttgatgaagcggtgctggtcatcatggttcatgtcaaattcgtgagagccttcaccaaaataaacgcacccttgtgcaccaatgctagtccatcactcatcaggctgttgcccagaaatttcagtatatggcataagaacagtacatatgctgcctggctgttgcccagaattgctgaaaatcaatggtgatggcaaccaggtccagtgcaggctgcacaggatgaagaaccggcgaagtagaagtatgagtgaagacagtggcaagagtgattgacactctacgactgtgcagtaatgagtggagcgaacagatcagagctctccattactgtaccatcgaccgttctacatcgccctgatatggcccgtcatcctctccgtaataagcacctccctcctcgtggcactgccctcgttcatgtcgcaagcccccagtatcgggtatcggcgacagaaagctctgtgagtaaatgacaaatccaactggaggcctgctcctcaattttttcttttcctgttttctgcgcaggcggctctgcaagccctcacaaaattgagcagatttttttagccttggagagctcgttcctgatgctccgcatggatcgtccccatagatcgattctggctatatcgactatggcgaaggagtcccaggtgtaacctgaggagggttcacatggttgcagccctgtctaattaagaaagccaagcaagttgaaaacactcgagcctttcgtgttcggggatggaacttaggaacaaaaaaagccgggattaccgactgcgtacctgagcagagccagctgctcgcaagtcagaccggatttgtcaacaaaggccgcactgagcagcagcttttcctgtgtctctgcttgcatagtgcagcgcaattcagttctctgcatagcagcgcacggctatacataaaggagcgctattttcccttttccagttttttttccttcactttacttcgttctccccctcacatcctctcagtcctttggtatcgcacctctctcctcttgtcacatttcataatcctcatcgcctatcgctcccttcgcttctggtagcaacaactacaagagtctccaaagcatcgcagtcggtccacttctcttcactttccctcttatcttatcgacacaccaagtccacatagacttcatcctcgccacagacaacagctatcatgcaggccttgacacccctccttttctcaatgctattcccgcgatccaacagcaacaaggtcacggtggatccagaaatcgacggcgacagtgagtatcctcacagcgctcttcttggattccaggatgggtactcgctgcacaacaacaaccagcaacccgtttcagccaaggcgcgacgacaccacagcatgggcgcagccagcaccggtccacgtagaagccgaactgcactcggcgagacagacgaacccgtccactctaatatcaatcgcagcagtacctttcctccagccagcaggacttccacaggccgacgccgtccacaacgcctgtctcttgatcatgcagcatttattgctacatacccgtctttggatgggctgggggatatgggtcctcgaccagcaaccacttcatccttgcacaagaagcgatcgccggaaaccctcccgtcttctcgcaactcaacgtcctccatctcgtccatggtgtctgatgcttcgaccgcctcgtcgtcgtcctcttcctcctctgtacgggagcccctcacacccactaggtcgccaaattatcgcagcacactaaagtcaaagaccgccacgcggacagccgctacaacaaaagatttgattagccttcagagctatgaggaggacgaaggacaagtctgcttgtcgccccgctcaaacaacgatgagaacctctcactttccgcagcagaggcactatccggaaacatcgcgacaggatacaaacccgctgttgctgaggcccgtggacagcgtcagttgattgcccattgagaacaacacgcctatcaagaacgacaccttgcacactcccgcgaacccggtacggggaatggcaaaggctggacttggtgtgttcatagctggctatttctgtcaatgtccctttttttcctctcaagctgcggctgctgtgcaacctgagctgagtcgtctcttcgttcaagttcaagatcacctcaggatcaagtctcgacaaaaccaacaaaaaaaaaggaatgcgcccttcggttgcggtctgttttgggggacaacagacccggtccagtctaggctagcttttcctgcaacgtctccctaacttcatgccattcagagcccagaaccccgctgcatttttgtttaccatagtccttgaagtctgtacagtccataatataccccctcttgtctccttgtaattttttttttggatccttttctccttactgtttgctgctgtggaatttttatgtatcttgacctcaagcacgttttttgccgtgctgggatatggcgccagaagggagaccatacaaaaggcagtttgctacgagctccttacgcctccctttatgccgtcttgttaatgcgaatgaacgcatccgcgcactctcacactaccctcaacgtgtaagcaaaacaagtttgcgttgctctgccggcctttcaaaatgacgttagacccctgtgggcgacatggaagccatgaccacaatgcgaaggcacacttgcacgatttttgaaagtctcgctggggccacatgcacgttcgcgacgtgtgacagtggcaaaaaatttccacacgacctacgtgtaggcagcagtgtgcgatcatgaaattgtggtaacaggcccatctctcagacgatctgcggcggggtgtgtgattgaagcccgatgcacagttccaagggttcttgtttctttctctcgttctctttttcaatcacatcctatagccctggacggcgcacattaacgcataacttattcgtccttcagtaccaacttgaagcggacaatggatccaagcacaaatcacagctgtctccgtcggcgagctggtcaagcattgctgccatttccctgctctccagttttgaacagctccattgagcagagtcatcatcactgtaatgagcccgacgctgacggaaccctggctactagattgaatactgcatgcaccccaacccctggtcatgaacacgcgtgggcgattgaacctccactgccatgtctgctgtcgtcgccctcgtgtccgtccccgtgcgcagttccgtgctctccttcatcgtcggaggaaccatcacagcgattcacaaaggtgccggtcgtctcagagtacatcgaggcaaatggccaggtatcatcgcagagagacagcgaggctaactggctgcaggtcggtggacagcgcgccaagacaaacctggagctcgagacgagagaacttcttagaacatttaggctacgtggtgaacagtggaatggtcctatccaggatctaggactggtgcgttcctcgaaccttaccgtaccatcagcttaagtacttgtaagggtaaaggacgtcataataactcatctcgctcgacatagacggctgcaggagaatcccatgcgagaccatcgaatgccgagtatcctcctcgtcgtacatccggcagcaacaggagtccggctgtcgcgaccgatgcgactgactcttggagccagaagaccgaagttcgcgaaggaggggatacgtttgtcattattgatatccatgataacacaattgtacctgatctgattttaccagcctcccccgcgtcctcgagtcgcactgctgcatcgtcggtatcaactgtgcgcacaaaagtatttgcggcctatcacccgatcctcaactctgagccgtgggagacagttgcgaacgaagcaactgtttccatgacgcggctacaagcggcctctcaagcttgtggagctggaacatccacacaggagggcatacaaagtctagcacctgatgttactgaacagacgcgacgtagcgaagttcgttctctgtcaaacactgatgaaacgacctcacacaggcgacggtgttgcagtgttgggttttggcgtgcttcaagtggtccgcgtccaagaggtgacgaaccgcctgccgcagtggacgtgtgttcaacagagggacgacagcagcaacattcggacgctacccattgccagtctaatagctctgtaccacaagcaaacaggttggagcaaggatatgaaggattaggatccgagcaacatcagagcatcatcgcacaggaacgagtgcccacagtggaatcggacgcgacagtctcccctggtgcggcagaggacacccgcgctgtactcttagaggtgagggaggctcaaacggcattgcacgattcacatactctggatgcagacagtcgaacgggttggaacgccatccaaagtgtgatcgcgattttcttgtgccgagcggaggtgccaccgatagaacctcgatctcatggtcaggatgagctgcgttcaaacccaacggcaacagtgtctgccattggctctgactgtccaacgtggtctacgtcgatcattgccgcgtcagccgagtcctcggaggactcctcaagcatactcacaagttcttcgtcacggataatctttggaaggatcttgcttggactggaggagttgatcaccatgctctcgcagcttgttaaacctgattcacggtcaagagatacccaagtcgtgtaggctgttgcaatcaaccatgtttacagcgctctttcaagtgtgttcatcgtccatagaaggtgtatatagcctacgaggacccagttcagctcgaggtacgaggatgcattacacaaacaaaaagcacacctttgaagctcaactgtggtgagtacttggtgcaaccatagcctgcggatgttaaaatgcccgtcatcgtatcaatgtttcccctaggaaggcagtgcgaagaaggagtatatgataatactggttcctggacctcctcggcatctttctttggaatgttgcgttgccatatgtggtcaacttgaggactgtgatgggtggtctgcgctactatgttcattcgttcttaaaaacaactgtggattcgaaacattatacaaactcatgctgctgctcttacgagtacaagctatcgatgctcaccgttcccaccttatcacacggtatcacaaaaaagaaaaccttcttgatcgtaggctacccttcgtccttcgcacgctttgtacatgtacggtctatttcggcccgcccttcgcatgtccattcttggtgatgtcctggctttgatattgcacaaaggcgactgctatgtcagaacggccagagattataagtgcctcaaactgccgaaagaatgcctcctacttttttctctttttttctcgttatcgcgctttcccaatcactacttcaccggttctcacactcttttgtcgacggtcagccatgttcaaatccaacattcttttgggtcttgccttcgtcctcggtgctgtcagcgctgtaggaaacaatggaaacaaaacactgagcgccagcaaggccccagcgatcactttgaccctttacacagcctgggatctcggaggtgtccaaagctactgtcaatacatcattttcgatcagtgctatactctccaagacgcaatcgtcgctggaggtctttcctcggccaaattcaacaacaatgacttttgggtacgaaggtttactgtaaccctttactctggaagctattgcaaccataactacgaccgatggactttcaccgagacgcaatataatgattacagcatgaaccagttcccgaccctgaacgaccaagtcaggagcttcaaagtcgccaactttaaaacatcgaccgaaagcggcaacattggtgcgcagccagaggatgccaggatgtcggaatgctatcaaaaatgaatggcatgcccaaatctcactccactcaaaaaaaccaataaaaatgtaccccactatgctatgaaatgaccagcgcggtcctttttcgtatactgtgttggaggagtgcagactcgtgaagacgtaacccgtcaggcgtgtgaaagtgggatgtcctttggcctttagcatgtctcgccgtgcacgtcccagacttttaccttggcgaaagaggtgccggtgaaagaaattgagcgcagggatgagggtgcagattcaagaatgacagcagtgctcctggtccatccttgctggactggaaacttggtctgtgcaaccgaacgccgagcaaaacgagagcaatgctcagcttgtgctcgagcaactgctgtttgttcgttttttcttgctggcgatagagcgagggggtctaacttctttaggcatgaggaaggaaaaagcgaacaattgctggggcagagtcgagtcgcggattacactattttgagtctgcaacacgcgtcgttcctatagtcaatgtcattccctgcgtccactattgctcgctattgatctccaaatgtgtaaagtaccttcaccttcttcctcatatctacttcctcgtccccagttgttgtctgctgtatttgatatcatgcattaacgttcatgtgcatacatgaagactagaggcacgaacacatattacacacacatagtgcacatctttggagctctgctgtgttcaactgctggtgcaaccggagctcgcggatgtcggacgcctgccatcgcatccaattcttctctaaacatcatgggcagctataggacgtgccatgtgctttatgatgataccatgaattttgaagtcttcaatgtcccccgcgccttcccttcatgtacattgagttgttgtggcagtagtgctctccgctgtcagcttgagagttgagacggaaggtaggcgaataacaggttacggagcgccattcgcattgccccttcttggggatgcacactcttgcccttcgtgttttacacgaagagcaaaggcggttgctccttgtcagaacggtcagtgactataaatgccccggttgtcttttcataaacttttcctcatccacttcatccaccgcaccagtaagttcgaccccttctccttttgatcgtcctcctaaatacccaccctctgacccacaatactccatccctgacgacccatcactcaaaaattgtacaatgagatagacgatgttcaagtcccatatcattttaggtctttctttcgttctcggcgttgccaccgcggcaagagacgtcaccgtgagcggggcaaagaacgataccgtgagcgctgccagtgaagcagacctggggattggcttcttcacggcctggtacaatgagggcgtcagccccacttgcaccgaggtcaagttcgatcagtgctataccttcaccgacaacatcattgctgggggtctttcttcggcctcgtttgacaacaacagcatttgggcgaggaggttcacttttagcctgtattcgggaacggcctgcaacggccagtacgacagctggggctttgtgcacaccttccaagacaagccatacaaaatcatcgcattcccgactctgaatgacaacgtgaggagtttcagagttattaacgctttctcggggaaagagggaagctatagtggcactaagcactcggccgagcctacactcctatccacctgctggaattggtaggatggaaaattaataaatggaccaaggtggtcaaataactgtcgtggtcgtttcttttaaccggccccttccttgaatgcgtgagaagagtgtgagaatggaagactgcgcgccctgcaagcgtgagagaaagtaggcagctgtaaataagcccttcgcatccagtgttacgtgcgtatatctctggctccaaggtcgacacagagaaagacaacattgaacgcgtcgttcggttagggagggggggggggggggtgatttttttgatcgtagagagaaagacgcctctcctgttcacacattctgggccacgcatgtaggacttcgattgataaactcacccggcaaatgacactggtctcattcagcgctgctcttgtacctgctcacgcttagcttttgatggttatcaccccatcgattgcgctgattcacagaccgctgaacaattgagaattattgagcgacttcacttctcagttcttgtgcgttaggtaaagaacttgcacccaagacatgatcagcaagcaaccgtgcacgggaaacacgagggaggacacttgcgcaaaaagtacaggccatggactgacggcccttgcttccttgttcccttggttccttgcgcccaccagtgctcgctgtcgtttcttttctccgaatatccgcatttgtcgattcttttcattccagagccgaagagctgagagcaatttaatccatgaacattgaggaggcaggctactggttttgggggtgcttccaagggtgtgggaccagtggtcgcacatagtgctaaatttatcaagtttaaagtgtgtgcctggatggttgacacccttttctcgacctcttgtctccgtccattgctcgtcctcgtttcctcgtcctcatcctcgcatccttgccccaagtagcccttcctctcactcgcgctcttctccgtcagccttgctcgttcgcacacgccttgccatcctcgtcatctcttcttcttccgtttacgaacacccattagtgcaccaagctgctcatataccctgtgctcctcgtgcccatctctccgccagctccttcgttccagccctcgcccactgtccatcgactcgcgcctacaacacaatcgaactcttcctcagcaacactaacagactctaccgaggaacacccccgaagggagccccgccatgttcaagtctctcgagacgtggacgactcgtcgttacatctttttcatcacctggttcgtgctccatgtcatcctcttcatctttggcgtcctccgtgtcaaactcgacaaaaacctcatcaatctcaatggcccgctctcgtactcgctctggatcgcccggggtggaggcatgtgtctgatttgggattgctccattattcttctgcccgtctgccgcaacattcttcgtatcctccgcgtgtcgtttctcaacaagctgattccgattgacgaaaatatctggttccacaaaatcactgcgtactcgatcctcttctgtacggtggtgcactccatcggccactatgtcaacttttacaagatggatcatcagtacaggatcggcaccccgggcttcaagctcacggcggcagagctgctctacaagtcgcccgccggtatcacaggacacatcatgttgttgtgcatggtgctgatgtacacgaccgccaaacaaagccagcgcaacaagtcctttgaagccttttggtacacacaccatcttgcgttcatcatgctgggcgcactcatgtttcacggcattggatgcattgtcaaggacaaggatggccagtgcagaggatacgagtcttggaagtacttgctgattggatactgcctttatattgttgagcgcagcatccgtgcctatcgagcgagattggacacgcggctggtcaaggccatccagcaccctgctggtgtcattgagctccagatccagaagccatcgttcaagtacaagccaggacagtacatgttcatcaacatcccggacctcagcaagtaccagtggcatcccttcacgatcacgtcctcgccctttgaggactatgtctcggtccacattcgtcaggctggagactggacccgcgctttaggcacacgcatgggagtcgagaaggaagagcgaggcggcaatggcggccgaggaggcggtgctggtggacgcggccagcaggcggctatgggacccaaaaagtcgacgacaggtccagaaaagaacattgagctggtggatgatcgaggtgaggagattcgtgtccgtgcaggattcagcatgcccgaggtcaagatcgatggcccgtttggcgctcccaccgaggatgtgtttgatcatgagattgtggtcctggtcggttcaggcatcggagtcacgccgtttgccagtatccttcgtgacatttggtaccgtgccaacaacaatatgcctctgaagaccaagcggattgagttttactgggtgtgccgagacttggcttcgttgaaatggttccagtctctgctggcgacgattgagggatcgatgatgaatgtcaagttgaagatccatatctactgtaccgccgtgatgaagccagaccagcaccacaacattgcgctgcatctccacgatgattactcgggcgccgataccattacgggtcttcaggccctgaccaactttggccgacccaactttggagccatctttacagagctgagacaaggcatcgtgaatgggacgtacatgcctggagccaaccaggagctggtgtgcgatgtggccgtcttcttctgtggaccaggagcgatggccaagtcgttgcggaaggagtcgaggttgcagagcaagaacggcgtccgattctcgttcagaaaggaacatttttaaagctccattaccatttcttttcgcaggcttttaaagtaaaattcagatattaataccaagtgagagagtaattgctgcaaaaagatcgggtgtgtgcaatatttttctctgggtgttgatttcaatgggcgtttatgaagtaaaagcgatgcattgaagcaaaaaaaaaaagtaaagagtctaagaagttgatgttggtgattattgaagaaggaagagggaaacgcgtgtttgcaaggaaggatttttacagcaagaacttccaggcgacggcaccgacaatgacggccaagccgacgatgtatgagctgctgtagattcagtgaaggttgtgtccatgagaatgagataatggttggttcgagtggcgtgatgcgggtgataggcggacgcgacagacccgagaataaaagaaaaagcaaggtggaacgatagatatggtcagtatacgtctctgtgtaacatgggatttgcgggggctgatcgagcgctcttcctattcctgatgacaaagaacttccgtggctgcctctctctctttttcatatgtttcccgagacgaaagcagtagccccaaacttcaggatggtatttcctgatgctggcagctgggtgaaggagaaaaagaagaaaagtggaacttgacatcgtcaagtctcagaccctcaaaacatgataaagatgaaatgctcgcagttgttatttgaatccgtgctgaagaacaaaaaacaacgatgtcatcaaaacgttgcttttgaccagcactgatgtgcattgctaaatgcccagcacctctccctctaacgttatctcgtaagcgagtcgttgccttggtcctggtttttggttcgatgtcttggactgtgcggacatttggttgttggatatgttgaccagacccgagtggtatcatcgccttgcccttccctgtccctttcagttgattccgagtcgcccaccccttgcacgatccactcttccctccatgatgcgtaaatcgacctcccgtcctctaaaagaagcttttgagcaatgagaccaaccttccagagctcgagctctcgccagcggggatgggcttgggggtggtcgaggagggcgacttgggtttctttccagtagcctgtttatgaaaaataaatagggggaagggggaaagatattaaacattttgtacttttgtgcgcaatcacgcttggactgaaaaggatggagggcgcttatcagatcgaacaatgacaacagcgtatgtatgcatacacaacggccagctgaagaaggccattaaagaagtagagtgaagtatccggcgcaagggaacttacatctgacttgtactctccgacatacatcttctccatgatctcacgggcctcgtccgagtgtccaacgtcctcgaaggactcggtggcatccttgccggcctcgtcaaagaggacctcctctccaccagggtgctagagttttggccaaatttgaaacgtaggaaaacgaggtgtcaaggtcagtctgtagtggaggccatggtgcgcatgtgatggaggttgacgatggccgagttgatcagccaggaacaaggaatgaccgcatcgatcaagatgagagtagtgagatgggagagccagagaataaatgaatcaagtgagggggcgtggtggccggcggccctcatcatcagcaaagcgactctattgacttgcgccaggattgagcgcagtctccgagctccgagattgaatgttgggggaaatacgagggaactcggttcggtgcctgaagatggatcaatcaacatgagaaaacacacctcgtcaatgaagtctgtgcagtcgtagacctttccgcccacggcgaggaacaggctgtcccgggtgccgtgctcggcgaggtcagcgtcggtgaaggtcttgatctcggacatgatgtgcagtgtgctgggtgaggagaagtggtggattgcaaagaagagagtcgaagcggaaggagtctgaaaaaggacactcgtacgatcacttccattcacacgtacacatgggctttgctcgaatttattcgtacggtgattgaccctgggggtgaggggtgctgctcgttctatgaaacgatcttgcggtagatgacaaacaggataaggaagaccagcacggctatgatcgacgccgtaatcagcttgttggtcgccatgctaagagttgacaaaacaatagaacgcgccatgagtgagggtcaggtttagagaacaaagatcctcatgagaccaagcacttctagactccaacctaccgacgagccattccttttagtgtgcgtgatgccttatcaatgttggaatcagcctccaaaagcgtgttccgggtgtggatgatttgctcacgctggcctctaaggtcagacaagatgcccgctcctagcgactctgtctcgagcgcaatcttgtggctgtcctgtaagcgcctgctgctctccgcaagtctatcagtgccgttcagcagccgcgtgcgctggtccatcgatgctgtatccaagtcaacacctccgctggcgcctcccaaaagttcgtccctgtcggccgtcgatcgtgatgtggactgagcacgcttctattaaaaagatagccatgagcagtctgcgacatcattttcctgggaaacattccatacgccatgcagggcatacagtggtattcttaccagcgtttgtttcaggcgctcaagttccgtcttgtgtccacgaagtctggcttgaagacgagttctcgatccctgaggcaggttcagcagctccatttccatttgatgaagctagaagcgtgtgcagacgttattattttagctagagttaactgctgaccaacacaaacactccttcagtggtcacttgtcaggataacaacatctcaggaggtctttccgtacaatttcattagcctcatcaatctctctatccgctgcacgaagcgtctgctttttgacctctagtaaagagaagtaatcagggagagaggtgcgcggggaacgggtcgagaagaagaaacgagggcaaagcgttagcccagagggtagcgacgagcgactgccagaagtagagtagtgagactctctcccgtcctccgccaagcacaaggcaatggaatggctgctggcactgggcttgagtgggcgtagttacctccgacttcgcttccagaggcgttgagtcgctctctgatggagaccttgatggcctcgtagtcctgttcgtagctctcaaagagctcagagcctccagcagagtccatggtgattagtttttgtgagtgagaaaggggtggggattaattaggatgcaacgtggaggggcaaagtaagagaacaaaggaatggtcaaagagcatatgacttttttctaaaaaaatgtgacgtctctcctcttttttcactgccattctttttttgtccttctgcaatccctttttgacgcgacatcaggcacacaacacaatggacacgcacggcggatacaactacggctatggacagcaaagcatcaggcggagctccaatggatacgcggctgccagacggacaacatcatccaccgcattcgccactcaatcttatctcccttcgctacagcgatgtgtggccacgctcgagatgtcgacacagctggtacggagacgcctcacagacagggatttgctcatgaatccagtatgggatatgaaaacaggatctaatgctggagaagtgatcatcttgctcttatagctaaagtcctcactgtcaatgctggacgaagtgacaagtggataccccaggctcaagacgatcacatctcacaccaaggtaatacttttgtcgtcttttaccgcgataaatgcccaaagattaaatcatgcacactctgatccttttccatcttccatctagaaattcgaactggtgtcagagcaggatattgggagtgcacaggctgatgtatccaagaaggtggaaccacaactgtttgccttaactgacaaggcagtcgagattgttctcgcactcgagtcaaaggaataccaactcatggataaagttcacatcgaaaaggaaaaggagcagcagcgactgcaaaggcaaaaggcggccaagtcgggaatatccaacattaagaaacttcagtcgttgacaaggcggaaagatgagctgactcgaagtgctctcgaattggacgaggtgatggaacagaagcgggaagagtttgatcaattatacaaaaaagccagcactctggactcacagtcaggacaaccaggatccgtcaagaggaccaaacgcaaccacaacaatgtaaagagtctggacactggtatagttcagagcatatggcatggcgatagctcctggctgacgataacctgtgtctgtatgataggaatctcgggaactgagtaggaaggaagaagagcgaaatcgcgagatcacaaagaggactcaggaactgcgatcaatacagcaaaagattgaaaataagcgcaagtcaattagcgaagccagagcaagggtggagtctcaaggacgtgccagcaatcctcctggacaaccagactttgatccctgtaagtatcaaagtggggtggtatcatatacacggttgaagtgttgcacatctaacccatccaccattcatagcgaaaccatggaccatgtacaacaaccactacgctgtcttggagcacacgctccagtcgacgctcaaggttggagagagggacacagatatttatgaggaggcgtttgcacgactctctgcggcctatatgaaggaactggatgcgcggcaggcacaggtaacaatgtgttcgaaaatgaatagtagctgggcaccatggcatatatgctgatactcaaaacgcattcccgatttctttcatagacggataaggagcaggataaactgatgagggaccacacgaggaccctctcacagatgcggaacctatgcaaactgctctttccagaagagagtattggtcttacaatggtccgattgcttgagctgctggcaggcacctgggagaatgaagtatactacgagaatctcgtgcaggtaccgccaaataagcacgtatttgtgggacatgccttccatttttattcgatgagcacatgctaacgcttttgcttttccctgtgattcaccttctgttcaaagaacgagtttccgctggaggaggagcgacggcataatcttggccgtgtcatcaagatcctcaagttgattggaatcatagaaattgccactgttcagaggtcaaagaagggcgatagccaggacgaagacgatccatcaaagaccaaagagcaggtcgtgatacggatcaactacgactcctgacggtccaactttctttgcagtaaaaaaattaagcagtcactttcgcaagttgtttacatatccttttattgaagactcggtgctcaaactctcaccactcgcagcttcgctttttccttcacaacatggtgtccaaaaagtccaagaaaacagaagagaccagcggtactaccgctggagccctcgaccagatttccaacttcttcattctccctttgcagatgccctccatcaccacctcaccttcttcccctcacacctctgccgcctacaagaacgtccttcattacctctatttcaagaagcatgagtctcccaaggaggacagcaagacaccgaagaacaggacgctctttgttctcaacatcccggtcgatgctacagagtcccatctccgggacctgtttaaaccctgcggccgagtggtctcggtccactttatcaacaaagtccacgataccaacatgaccaaggaggagcgtgagcagcaggaagagcttgagcgtttagagagggcggcagcgttgattgaggcagagtcgagcaacaacaagaacaagggcggcaagaaggggtccaaaaacaagcaggcagcaggatcagcagatgatcattctcggacactctatgccacgggatcgcaggcctacgtcgtgttcttggaggagcaagagttgagcaaggctttggcaatgaagaggaaaaagagattttggatcaacactggaagtgaagctaccgcagctgacgctgccaaattgtcaagcttgggtctatcaagtaacgtatctttttctttttttcttttcgtatagtgcagtaacttgaccgtttgccatatcctgctttcttttgttcaaggttgttgtgctgaccgaattgcctttttgcgtctcatatagaatggatcaacgaataccacatgaagcgacctgaagcatcagtattgcaggtcaaggtcgacgattacatggagaagtttgagcggtccgaatacgaggctcagcaggcagcgctggcgagacacaatgtcatggacgaggatggattcacattggtcacccgtgccggaaagggaggccacaatacagacggcgtcatcactgtcacggcagccaaagctgaggatgtcaagaacctcaagcccaagaagaaggagcttcaggacttttaccgtttccagatgcgtgaagccaagcgcgacagtacgttgaacatctttgcttggatcagaacgcagaggacgaacctttgttctatccttatcactgctgttcatgatggaagactcaccatttttgattttcatttaccttttctcactttttccttctagaattggtggatcttcgtcgcaagtttgaggaggacaagatgaggatcgaggcactcaaagtcaacagacgcttcaagccctactaaactctctcacctccccctccccctcccccgcgcatcttcatatatacttatcttttcttttttgcatatcatcttcccgaaggatattaaacggcgagctgtttcattgaatggacgtggttctggctgttgtttactcattcttgataggtgacatgaattctggtacatgatcgccagcgctcgcttgtttaacggcaagttccacagacgctatctcttgctcagctgatgacagcttggctccatcgatacaggtcttgttgaagtggtagaacgttatggcgttggggctggttccaatcgctcgatgaagaataaagcgcctctgtcctcgagcaatcttttctcgacacgtctggcatgtcggcagcgggcctcgcaggcctacaacctcggcgtagagtcccttccgaaacgacgtattcttgcgaggcgctcgttctcggtgcgtagacttgggcgaggttgtcgttgttgaaatcccctccttgtagccgctccgaccggctttggtcaagcgctgatcccaatccatgtcgccaccgcccttgctgctgctgctgctgccgttgctgccgttgatatcatggctgttgatgttgctctgttcctctgcaggctctctgctggtgctgtccaaattacgctcttcctctctactgcttgttgtcgcttccttctcctgcaagcacgctgtacccacgatggatccagacgctacgacggagtgatgggtgttgctgtagtaatgttgcaagtctggcggctgcagtcgttccacaagcacctctgagggcacagtttgatcgaccgtgctgatcaggctcggatcagacgttactctatcactccttcctaagtgccctgtacggagagtccttaggtccctatccatggtggcccaggccagcgagaacgccacatggatgtgctcaatgcatcggagttcgagccgttgcaagacagcgatgctcagtgggaacccgtcgtcatactcgagcagtatctgttgcagacctttgcaaagggccgtctctactgtggacagtgttacgttttgcatgtctatgcactgagggtgagtacacaatggaatgaaggttgagtggaataacagaaaaaaaatgactgggaacggttatgtttttttcgaaagcgctttacgacctctaacgattattacgactgtttggaataaattacaaggcgtagcaaacatttcaacgatcaaattctcgtccttcagcaggtgggagatatccgtctttgagcaaaccctccaactgggtctttagtcgcgttgttcctgcaacgcctttcttgggcatcaaagggataaaatccctgaccaggagctggatcaccttcctggcttggtttccatacgtcctcatgtatttgtctccgcagacctgatcaaggaagggaacgaagagggtaatggttagtgttcatgttcgaaaaacattttctgtaacacctcgacccaactcaggatacgaacctccaggaacacattgataagtgacggcgtgatcggccaaggcggcatgttcacgatgcgagccatccatgtccagccatgcgacaaaggatacgcgttctgtccctctaatgacggttacattgaatgcaaacatcagcattgattttcacgaatacacggagccctcgatcgtggacaagggactgctgcatagacgacacttacggataggagttgtctgcagaatagcgcaataaagggtaaagattgcgcactgacgtgcgttgtacttgtcctctttctcccatccgccatccgaatgcttgtagcccagtttcttgaagtattgttcggtggactcactctgtgaggaaagtcatccattgcgaaaataagatatggcgatcagtacgctataacggcaacgtggcgacctgaggcgctccttaaaaactccataagaactcaaatcccgactgccaacccacctgatcgtgtgcaaagtacttgggaatgacatagggacacttcttgacaaatcgagccataaggacatcgaggaaccgcgcgtgattggtgaacagtagcactgcgacatgggctactgggaaggccggagcggacttcactagtgcctcgttctcgatttgttcctaaggtacaaattgaaccatgcgcaaaacgcgtacgctgtttgaacaaggtgtgcttcactttgtagctctctccctctctctcaggcacgacgcgatgtggaaggtcatccttaccaagaacttctttcctgtctcgttcatgagccagttgtaagcgttctctccatgagactgcttcatcctcttgaagactcgatcaatgtccatggcctaagaagatgtgacgaacatcagtacgtgcgaaggatctgtcgttgtgcactttatattcaatgacttacaactcgcatgacttgctcccgcttgttgaagagctgtccgatgaaaggcacaatttctctcctagcctcaaagcagatcttcttcaaatcgcggttgttgacaatgccaggcttcacgaccgtccgaagatgcagaacaattttggtataatgctgccattcctcctcagcagtgtcgctgacgaaggtcgaactgctgttagagacggctgcagcagcagctgctgctgcctttttggccatttctgctgcttcctgttgcgccttcttttccttggcttccttagctgcgacttcggccttcttcttttcctccgcctccttttcgagcctctccttttccaggtttgcatttctgatggcctcttcccggattcggatggcggtttcccgttcctccttgatccttgctaaacacgcagcgaattcctaagcacacagcaagtcaggtacacaagaaagttgaccagcatcaataccatggtccatcatgcgtatgggcagcggcggtcctgaacgatccagcgcagtcttacattgtccatggcctgattcagtgcctcagtttccttgcggcgcttctccttgatcgcctcagtctccatgctcatatttcgaattttctgaatgatgtcgtcgttctctcccgtccacgaaagctgcgtcgcttgaggcttttttgcgatgctgttgaagtcattggtgatcttgtccgcgataactggagccagctcctgcgcgttggatcaatgtacatgatatcagtcagcaaatttgatgtcagtccttttttttttcattctgaactacaaaagccaagaatcgaaaaaaaagtaagtgtcctgcttacctttccggactcttgtagtttttgcatcttgagttcccacggatccatgcggcccgtgatatgggccacgtagtgagccgggctattgggatctatagtccggctgtctttcctcagtccagcttcagcaacgtccgtgccatttacctgatccgattcatagtcatcgctacccgagtccggatcctcgtcgtccgacgaaaagtctgccaaaccgtagcccgacacaacagcgaagcgtctgctctcaccgaagcccttgcccttggttgttgcaccatgaccgttgactgaactcattgctgcgttggacccattcctatgttttgcgcgaactgtcgacgcgagaccgacattctggtagtatatggaggggttctgggagagtgggcgacgcgagagctgactacgtgagaggtcgacgtcctcgattccgtggcctgaagagtcccggattccttttgaaagacgcagttgtgccagtcctggatcgttgtccctgatatggccctcggttatggaatgcctgaggatgagctcgaacggaagtccttggttcgcgggcatcatggcactaggcttgagtggtgggcgcaagcaaaattgtcgcttggaagtggagttcgaggtgtcaatggtgaacgtgtacgcggcggatactttctggggctagtctgaacacaaaaagagaagatgctgtaggtatgccgcgcggccgtggtgaaagagtgggtcaggatgccagagaggcaaagcagtggaggtgacaaagaggagttttggtgtgtgtgttttgagcgggccaaaatgagatgttgtgactggcatttattgtatgatttgtgagatggacttgagaacctcctacaggtgggtggcatccttgccagtcaacaacttgtatgcctcttggtacttggccatcgtgttgacaataacatcctcgggaagtgtaattccagcactcctgtcgaatccgatagagtcgaggtagttgcgaaggtattgcttgtcaaagctatcgagttttcaagataaagaagaaaaaaaaggaacacggtcagatcatccacttctttccgatactctctctgacaatcatcgcagtctgacgagtacctgtcctggccggttccgatcttgtaggtggcagctggccagaatcgagaagaatctagaaacggcaatacatcactcgtcagtcaacccatgcaaactcccgataccataataaccacacagaagcgattgtctttctcaagaaacataccgggcgtcagaacctcgtcgatcaggtagagggtgtcattctcgtcgacaccaaactcaaacttggtatcagcaatgataatgccacgttcaagcgcgtaatcacgagccttggtgtaaagttcaatggagatccttgccatatcagaagcgtgcttctcgccaatgatgccagcagccttgctgggatgaatattctcgtcatggtcaccgatctcggccttggtgctgggcgtccacaatggctctgggaaagcctggctctcctgcataccctcgggcagagaaatgtcgcacaccgttcccttcttcttgtactcagaccatgcggaacctaacaatgattaaggatattccagacagtttgaaggatgagaacccgagtgccactcgctcgctttagatgccatcctcaagactctgcagccaccacaatagccgagtttctcatggtacttaccagtgatgtatcctctaacgatcgattcgattggaagcacacgtagactcttgacgagcatagatcgtccctcgagctgattgcggtactgctgaactttggcaggcatctcctcaaagttggcagtgatcaagtggttgggcaggacatccttgaggaaagagaaccagaagatactaatctctgtaaggagcttgcccttgttggtgataccctttgaattgaaaacatccgttcacgagtaggatagggtcagtcagtaacacggcagtgtgcagagataaagcgagggcgagagagtgtgtgtgtgagtgagtcatactgcacacgagagaatgaccggatgtgattttcttttttctgattcacctacattgttcatgatcacatcgtaggcgctgatcctgtcggttgcaacaaagagaagcgagttggcatcgactctatagagatcacgcacttttccgcgcgcaatcagttcgagatccgggcaggttgtggtgacgacggcggccatggttgtagagcggaagagcggaggagcggggagcaagtttgggggtgagcggtgaaggaaataaaagtgaaaagaagagagaaaaaggaaatcgcaaaaatgcggggatgggaaaaagataacggaagaagctgagattcgatttgtactatagaggtgttgcaatcgctctggctgcttgcagtgcagtcagtcgctagattgacgcgacgcgacgggtgcactgtctgagggagacgctgcttctaggagagaggcgaagagattcgatcagccctgacctgtcctgcacacgaggatgggaaccgagcgatcgagcccgaacatgcacgctccagagaactcggctcgcttcgtactttatctcaaaaactcaactttgcttcttgcttctccatttctccttttcaatccatttctgcctgccttctcacgaagacttcgcacagttccttctacacaacagtcttccacactctcgtgcctcgcctctatgaaggacaccattgacagccccataaaccagaccctgactgctctggacaagtatgtgctcctgggaaaatccgggctccgcgtcagtccactgtcacttggaaccatggtgaagtagcaagatgcaacgtacatgcagtcatattgagaggcattagcactgtcagttagctaactatgatcaatgacatttgcctgttagacctttggcgaggagtgggtaaggaccggccggtggatctgtgcagtcgcttcgctgacttgtcactgaaacaacaaaacacgatgattgaactcgtcccttctttctgatcggtgaatcgaacctagggctttggcagcaacaaggaggcctgcaaaaagatctttgacacttatcatgaaagaggaggcaacttttatgatactggtaggcgagtgtagccattcacgttgtgccatggccctcagttttagtctacgacccgttgtcactcactcattgcccttgcctgcccaatgctgctttagcaaacatctatacgaatggcgactcggagcggttccttggcgagtatatggccgacaagaggagcgagtgtgtgatcgcaaccaagtactcgagtatgtgtctgcttttcagcgcttgtctgatgttcagaaaaaagagcattgcactgacagctgcaacccattgaaacactttgatgccagtcaacccttcgacgaccgaggccatcgcgggaaggttcagtcgtcctaatccaaatgcaggaggcaatcaccgaaagaacatggttgagtcactcgatgccagtttgaaacgcctgggaacaggatacgtcgatattctttacgtgcatctgtgggagtatcgaacacccattcaagaggtcatgcgcgctctcgatgatgttgttcgagctggcaaggctctttacgtcgctgtgagcgataccccgagttgggttgtgtcttgtaagtcagcaccgtcattgcagccatagtatacaccaagagtcgtgagcctgattatttgcttccatcattgtgtgcaacacgtttgaatgatgaccaatagcggccaacaccatggcagatctccgaagccttacgccgttcattggcttccaaactcgctacaatctgctgaaccgctcgcttgaatcggatattcaacccatgtgtgctgacatggggctgggtatcattccttggtcgattcttgcagagggatttctgtctggaaagcattccaaggagaagcgagacagctccagcaaacgacagggcattgtgaaggggcatttcaaggacgataaaaactggcagatcctggatgaggtcaaggccatcgccaaagaatgcaacagaacgccagctcaggtggccgtcaactggatgttgcagaagccaggcatcacatcccctctagtgggagcgcgcaccctggaacagttggaggacaatcttggcgccttggaattcacgctttccgaggagcacatgactcggcttgatcttgttagcaaccccaaggaatggccgttcccgcaggatgtggcgaggaacttagagaggtttacaggccttggactcgaaatcgagatgcctcggcagttccatgcgttgcaaaagcttcgaacaagcaagatttgaaaaaggataatcttctttattcggatcaacactgagaacgagggtataggccccaagaatagagtgaatgtcgctacatatcatccaatcgagtcaagtggacgttgatgtatagactagctctggttttaaaccagtcccggcacgggtgtgggtgcaggtgcctccacggggtcgaaaacaacggcggcctcactctcagcttgagctttggcacagactgtgggctcgggcttgcactctggaacggaagtgatggtcacatatttgatgcagcacttgcccttgccgtttttaccgtgtttgccatgcctgccatgcttatggtgctttttgtgcttgaaccacattgcgtcctgtccttcactcgttaaagtgggtgccatatccactgcggactcgggtgcttctggtgcagctgcctctggcgctactgaagcctcagcctgagctacgtcctgtgcagagactgaggaggcgatggccatagtggcgatcagtaggatgctgaaaaggtttttcattgaagagtggagggcgatgggtaaagaaagtgatggaagactggagatgagatcgacagagatgatgcgaagaataagaacgtgctgacagcgcagatttgggccggatgtaaaatttaggtagaagggttggccctttcgcccaggtttaaataccccacacagcaaggccactcactatgcctttggacgtcttgttctggtcaatcctagagcgttcgaaggcgatcatcaggattcccgtgcgcctttggtatagtacgaggcgacagcattaagtaaaccaagaaaaggagttgaaaagaacgctaagaggaccccgagaaagcaggaggggaagatagacagagtctctatccccttttcatcgtcgccaagaatgaataagggcagtcaggaatcctggcaagaggaacggagttggtcaaaagcaaaaggacttacaggggggagtatcattccgtttcccaactgagcagaaggaatgcgactgatcgacaggatacggcgcgtgcacgaacaaaaaataacgccggccgtattctctgcgtggataccagtttttgcgctgagcactatcatcttccatcactacggcaggtcgcgcgttaaagatcaaaaaaaaaatcttttgtcgaaaattttttttgttttcacttggcgcgagtatttttggcctccaagacaggactttggagcgtgtcgatcgcttctcgataattctttcgttgggtcttgcgcattctctcggttcaagtcgacgaggaggagtctcatcttctataaatccggggcctcattacgaatgtctcagcgcgcatgacggtggtagaaccactcagttggagcagcccgccttatataaaagaaagtgcttcttttgtaaaatgtagtgatgatcccaagctcttcgttagacaaacatcaacaccatgaagttccttactctctctgctttgttgcttgcgcccatttcactgcttgcctcggctgagcattgcgtcgacctcgactctgagacgccgagcggtccaaaggttgctcgctcaagcaacaaagggagtctctatatcaagctaaacagtgccagcaacttgcgcgacaaggacctctttggtaaatcggatccctacgtcgagatgtggctcgaggacaagtacaagtcgcgctccaaggacaccaagggactgaaccccgtcttcaacgagaccttttgcttctacgtccggcctggccaagacaaactgtatgtccgagctgtagacaaggacactttccgcgacgacaagatcggccaggccactgtccccttgagcaatgtctttagcactggaagcgaaggacccaaggactatgacctccccaagtggtttggacttcgaagcagcggaaagatcaacatgcaaatgcgcttcattgaggaccgctcgtcataaccgcttggacttggcactgcagaatcgcagagtatcagcatagcgctggcttgtaaagaagagagagatattcgcgcaccaaagattataaatgtgtattgaaacgatgcaagtcgattgcccatatgcacattcatatgtcggttgccataggtcgaataaggttatgcagtggccaactgggacagggccatgaccaagcggcgggcttggaaaaaaaaagtttgacagacacacacacacccacatacacagcacacccagatacacaacacacatacactcacacacacacccccgctgtccgtcatcccgatctttccatccgcccgttgcttccatcgctgcctgccctcgcccttgtcgcatctcattaccactctgtcccaggtcatccttgactcgtttctcttgtctttcgctctcgctctcgctccacagcctgcatacagtgctctcctccaagcgggtccacccatccgttccttgttgtcgcactttgcacctctgaggagcatccctcgatggccaaccacaacgagttctttgctcaacaaacgtcgcctgtaggcaacctggtgcgttactactggaggacaaagagggtaaggatgcaggtcgagatgggcagaggtcataacgacctcaacggtcctcgacatgagcgcacttactgatcatcatgtgctccattcgacatccttcgttctctactctccagattctatttttgatcccagcagccctgtcgctatggtctgtgttcctgcttctgtcctttatctcaacggatggtaagcccttgccctgtagtctctcgctggtcctttcccctttttttttaggacactgtggaatcaaactcaccctcacctcgaacggacaacgactacaccgatagatccagagttttcttttgaaaaggtcctcggcggcgacgtggatgtgtccaaggcgacgctggacaggaatccaacaaagttgaagccaatcctccttcaacctctgcctgagcagcgccccgagtatcagtggcctcccaacatccgccacccactctgcttgcccaagatctttgtgtaccccgacagcatcaggatgggagagttccaagtctcggagaaccctggcgtgggcaccaactatatagctgagcagatcctgttgaagcagcttcgggacaagtcctcggacgtttacaagaactatgtcaccgagcgccccgaggaagcagactacttctacatcccctttttgggcgccaaatacttgaccgattgctggttcgctcaaggaaagaagggcgactgcgatgtcgacgagaagtatgcagagccgatgatgaaccacattcagcaggactacccgtactggaaccggacgtacggcagggatcatatcattgtccaccccatggattcgacctcgaattattacaaatcaaaaggccgtatgcagaacgctacctttctcaccacagtcggcgatctcactcgctttgatcggtcaagacgctttggcgacattgtcatcccctcagcaacctcattgctaaaccttgcgtttgcgaaccccatggaccacttggacgccaacggtcatccccaatccggcaccagggacatctttgttctgtttggcggaatttaccaggacgtcaagcccgatgatgtctactcttcaggcatccgatcattgttgaaggggttctctcaacagtccgactatgtggttgcagcaggctgggacaatcctacttacaccaagctgctcgcaagggccaagtacggtttcgctcctcagggctggacactggacacgacacgcatttgggaatacattgcctttggagtcgtccctatcgtgattgcagacggcatcattgagccgttcgagaacgatctggactgggacagctttattgtgaggatccggcggaaggatgcacatcgcatggatgtgatcttgaggtctattcctgcggaggaatacgaagccaagagactagcactgtggaaccatggacgccagtcattgctggatcacgacgcctggaatctcattgttagggatctttgtcgcaaggctggacttgagggcaagcgaaccattagccgggacgtccatgtggacttggacagcaatgcttcggtctagagaatgaattttagaactgtcattttacatctttttatcaaatgtcacattgcaacacaaggctaaagagctgtcacctagagcgaatggaccatcttcactgtctaaggaaaacgggtgaacaaccttctatcgggcatagtagacgcaaactagttcttgaaagacaaaacgcgatcgcacccccgttactcggctagaaagatgaggagtgaattagtagagtttcctttgttcctaccaaaaaatatgaggcactgcgccgcagccgttctcttttccggcaatgacacgcggcctggagtggctctgacagatatgaaatgcatgtgagtaagaaaatagagagggacgccaaagaacgccgaggaacgcctgcgtcgtctcactcaatcccgtctcagttaaaaccaagaaaagtcttggtaggaatgttagagctgagatgtacagcagcaggtctctcgtcgctcttttctttggccgcctctgactctccaaagtggcccaccgacgcgaattatgcgagagaaaggcatcatccttcgtggctgcgtatcgatcacacgccgttgatttgagcctgcctgcaactgaagactagggtccttaaggccgcatttaacatcctgtggtcatgccttttacgatacgccccccatttcttttagccgcacactatacccatcagcccattagtgctggttcaaagagaaatggtatacaccaactgacccgattgaaggtggagaaatcacgagcctcagcctgctggaaaaaaaaaagaaagcctcgcaaaagcgcgttctcacatcacaaggtacaaaccgccgcgctatggaatccgggtcctagtcgcatctatgctgtctgttaccaagaggggtatatgaagagtaaagtgacggcaagttatgatcaccagtgcagatgttgcgccaggtactgctctgtgggggcggcggagagtacatgaacagtacagaccagtacatgtctggtggacgattagggggtgggccaaactctcgccatctaatagcctaaaattagggacaaccagggttctgaacaaccacaagaaaaaaaattacgcgttagattgctgatggccgaaacagagccgcccttcttgttacggtctatagtggaagacggatagtccatgagcaatagaccagtgtgaggcaagccagcatgggcaaaggggggctgtgttcaccgtctagtattcttagaatgcgcacctgtccgtgcttcctatctcttctttcctccccgccaaaaaaacttcttaatttagaggaggccctgatcagtggccttgctgtattcagtcgcgtccatagattgttgacccggggcaccgagcctttgactgtaactgaacaaggtaaaattgaggcaatgtacaccatccatattttctccatccttcaactcttcgctcctgttccgtagactaggatcggcgcccgtcccgttgctgttgcagacatataaatacgcgtccgaagaaggcgcttcctctctctcttaccttgtctctctcatccttgctccctcatctcaaccaagcatttaacagccccagcgtttccctacaacgacacaagaacaacatccacgaaaacaaaaaccataaacacgtaaccaactctctcttttttcaaaaatggacatggaaccctccccttccgtcagcatctcggtgtctgcctctccttccatctctgcggaggccacctcgatctccttctctccttcagcctcggtgccttccgtcaatgcgactttgtcgaccatcgctcccatggtgcccacggcgatccggacgtctgctgtggctgcatccccaactgcgtctcccacgcccaagaaggcctcgagtgcgaccagtttgcagatcaagctttcgggcatgttcttggccatggtcatcctgcctgtgatcatgacctctatgtaatagagtaataaaaaaagggggggtcgaacaggacattgacgtagcccacccctcctggagctcgacataaagccgtacccactcttaaagcgcacagtggccaaatatatatcctataatccaatattactcaatgagagattgtagtttttgatattgcgaagttggataatgagcgagggtacattacgattcacttggctgatttcatcgagggcaacttctttgcctttaagcgcggtttcaacgacatctctaaaaagaaacctgggaccatggtgaagttaaggtcttagggctgtcacttggagtctacctgctgccagctttgttgacgtgattatcgtgacattgagatacgcccgctgaggagacaaggtctcacgtcgataatggtcatgagcatggctaccaggtgcgcgccagggttaacgagtgaagtgaagctgagtgaagccgagtgtttcaacaaatcgcgaatcgcaactgcatctgcactttgctctgtcccgatgatgtttagcacttgttcgcaccaacacaacccgtccagattagaaaaataagtccccgcactccagccttggcaaatctgaagacctccagaagagaacaaaaagagtgtcggctgcctgtataagagagatatatttgagagattgtagagtgacagcgaaggggaggaagcggtgaagagcatctgtgtgacatcccgtctacagcaacactttccagatcacacatccagcaacaacagccagggcaaggatgtattggaggctagatgggatagagataaaggggcaagaaaatttcagtgagatgtgtgcatcatcgactccaaaccggttttgtttccagaatttcccggaccatgaggatccgtgagctgccacgccactgctctcccatggaaatagtcctttgctcatcaagaggaccatgccgatggcattgatgccaagccgtgtcggatgaatccagagtcggcgaacacgcttctgcacggccacgtcctgcgtcacggtgtaccagcgtctctatctttcgtaactcctgataggtggaaggcgacagtagcagtacgccccaagtccgaatcgatcctgcgcaattgtttaccttccagaatccgaaggctcggcggcagggatgggtctggggacgcttgaggaaggagacttggccttgggtttctcggaactctatcgaaacaatggtttccgttcagagaacgatcttcgttaggtgacatatccttagcacatgtcattcaaacgggccctccccacgcttctctttttcacgcctgttatgtatgtttgttcacttaaacatgagggttcacatccgtcgtctcaggaaccgcacaaaacgggatgagagtccaagacgacgagaaggtgtacagcataatgagttaacttggcaagggacagaagcttacatcggtcttaaactctccaacaagtagctttgacatgatctcacgggcctcgtccgagtgtccaacgtcctcaaaagactcggtcgcgtcccgaccagcctcgtcgataaggacctcctctccaccaggatgctaaagtaaagagtagagaaaagagtgttgataccttcagttaaacactgcggatggcacttccaaaggtcccaatcgtcccctgcgccctcgcaggatcctgatttcttgaattcactctgcccgtaaggatgattgacgctctctctctatgtctcctcatgcgcgcagatgtgcaatggagtgtacactcggtccatgggagcaaaactccgagccgagcaagggccctcttcggagctgggaatacagcctggaaattttctcggaggaagtgaactggcccgctcgggatttcggaatggagtccctacctcgtcgatgaatcccgtgcagtcgtagaccttcccgtggatggcgaggtagaggctgtccttggtggtgtgctgggacaggtcggcgagggtgtaggacttgagttcggccatgatggggtgggatggaaaccgatggaggagtgttgacgcgataagggagggggggggagaacaagaaagagcgcaaacgcaaggaagaggtgcggaagccgcgctgcaggtttccgtttatttttatatgggtgaacaggctgactggacactggacacgtatcaaaattatcagcgcgccatggtctcagctggccaatggggccggaccgggtcctccgctcgtttccacgcaacgcctgcatcctgctcgtgtgagcatatcgcttcgggccagcgcacgccgcacatccgcaacgagggcctcactgcagtacgacaccacccgagagcaaccgtcgatcgacagccttctttcctgcttccttacgggtcgtccgatgccgcaaacagcctgcggtaagcaataaacaggatgaggaggacgagcaagactatgactgccgcagtgatcagcttgttcgccgccatcctacgaggccggtgcagagggtaccgtaggtcatcccaggaagccgtttggcgaccaacagccccgcgatgtgtttttgtatggttagcagagctttcgcgccatcgtgccccatgaggtctttgcatacacaacacaattgccatagcttccgccaaacagatactcaccgacgtgccatccctttcaaggtccgcgatgctttgtcaatgctagagtcggcctcctgcaacgtgttccggctatggatgatttgctcgcgctgtcccctaagatcagtcaggacacccgccgcgagagcctctgtttctagtgcgattttgtggctgtcctgtaaacgtctgctgctctgtgccagcctgtctgtgccatacagcaggcgggttcgctggtccatggatgctgcgtccagatccacacctgtgttgagtctacccagcagctcgtccctgtcggaggtggatcgtgtcgactgtgcgcgtttctgtgtgaagggatagccgaatggatcaggagctgactttttatgggactgcgggccgacacatcccgagcatgcactatacaccatgagatttctatgggacttacaatagcttgtttcaagcgctctagttcagtcttgcagccgcgtaacctcgcctgcaaacgcgtccgggatgccaatggcaagttcagcaactcgatctccatttgttgcagctgtcccgtgcaaaaaggaaagagatgagcaaggacttgtgagtctgggagagggcactttcatgcaaaaccatcacacgcacatgccttctattagtgcgctttccagctcatggtattgggtgatttaaacccccctccccctatcgatatcttcagcatcccgtccccagtacagtgcaggtcacttacaatctcgcttgcttcgtcgatctcacggtctgctgcccgaagagtggcctttttaggctctatccatatgaaggaagagtggtgctcaacatgatcagaaactacatagtcaaccaaactctgatcaggaaagtgacgatgttctgtggacaaaaacatggggttcatactagtcgatctgtacaaatgaacattctgtgcagtgctttcaaaactaggggagcaaagtacttgcctccatactggcttccagaagtcgtgatacgttcgttgatggagaccttgattgcctgaaagtcttgctcatagctctcaaaaagttcagagcctcctggagcgtccatgttaaagcggcagtgtctgtgagtgcgcttgacagcgtgaagctgggatcgagtcgagcgagtgaagtggatggataacgtggatgaatgtaacgagaaggaagagcgatgggagtgggaacaagacatgaattctcgtaaggaatcgtggcggagccgcgacgatctgacgtaagctcgggtacaaccgcgcgtaccgcgacgcgcttctagcgtgaggcttccagattgaaggcagtgcttcgcgacgagacttgactgacctcatcgctactctgggctcgatgagccgagtgggaccccgtcatgtgcataggcggcatgcagtgtggtgtgccagtgtggcccgatattgaaggccatgtccatcagtgccaatgtcttccccgtgttttctgtaaagtcctggctctcattctcgctcagtcactctctgtgtgtggtcccttatccgtttatttaaaaataccactgcaacacgaccatagcgacatagcgagtttggctcgctcgttagatgaaggaaaaaagagaggccagatgagagacgaagagagaggacaacagagcgagtgaggacaagagcgagagagagagagagagagaggaagagagagagagcgcgcgcgagagagagagaggatgagaaaaagaatgagagagaggataaagagcacactgcacctgaaatagacaaaggaaaccaaggaccaaggaccaaggcgtggaagaatagaccttgggtctcgcttttttttttttttttttttttctttctgcgagcaagctgagaccaggcgaatagaggcaagaaaggctgaccacgcaacggacaaaaaggaccgcccgcactcgccgccttgggcaaagtgcgattcgaatccacctttgtccctcctatgatcgcactgatccgctcctgattccgatctccatcgcccttggccccagtcccagccagcacctcaccaccgcagacgcccattctcccctccgcgtctcacctgcgcgcacgaaccacctccgccccgcgctgctcatgaccgccattcctgccccacacattccacagcacacttcaagaacaacataacatatataacccgactataacctcgtaaggccagcctgtccagcatccctcctgcccttctccacgcacatcgccttcgcttgaccatggcctccttccttcctccctcgtgagtgagggtggagaggtctggggccaaaacaagtcacgccacgtcaatgatcgctgtgctcacaatacccttcttttttcatgccttgcttcaaccacaccctttggacactagcctgcagtcgcttccttccagcctagccaaaccactccactgctagtcgcctgacacgactgaaggaggggtgcccagaggactcgcccatgtccggccatggtcgcaaactcataactcaacgcggccacgatagtacgagacgcaaaagcagcagcaaggatgaacacgggtcagcactgcttcaacgccaacagacctcattagcccaccgactgccatcatcaagggcctcctctatatcgacctcgtccatgatgtatcaggatcacccccgtgcccatgggcaaggtgctcccgtacacgaggaagacagcgatagcgattgtctgtcaaccatctcacagtcttctgcgccatactcctcgtccgcaagtacagcgcctattcgtcgcgggcgagtcttcaggaggctctctcgagtccctcaacccctcaattctgcttcaggggcgattagcatgtcgcccatggatgcaaactctctctctcgcaatcacacaccttcctcctcccgttcaccgtctgtgtgccattcccgatcagcctcaccgactctgacctctgactacggtctggacaaggtcgacaccgacctcaacaggctgtcctttgaatcaggaatcaccccatcaaccacccttctcgcctcctcagctcgcacaccgacttcatctaatatctcaatggaccctggaccaacaaaatcaaaaaagaaaaggaggagcaggagaagaaagcggtggagcaggaccggtggcgacgacggcggggacgaagacgactctactgcaactatagctgcaaacaccaccgcagggtctcctggtgtgtccaacgtggttgagaggacaagggacgactcctcgtactcttcgtataaatcttcgtgtgcctcctcacctcccaaaactaccaacggtatccagagcaaggtcgcaggtcggccacagagcgactccccccactgcgacgacacgatacccattccatctcctctgacgcctccacattcagcgacgttgggctctcttgaaagtcaactgtcgcaaacccctcggcagtatgctcagtccgaatcgtccgtcgtcgttagtggggccctaggctcttgtctagagacgtcgaggctggagagcgctcaagctgttgcgcttacgccagatgcgtcgcctgaacgcagccccacagtgccggacttgggcgcgaccatggacatgccagcaccggcttcagtacccttgccatcctcaccgactctggcagccaaggcctttccacacccttcgaccaccaaatccgtgtccttgcctaccatttcgggatatctttcatcctccaaggactcaaaacagtcgccgtctcccactcctcctccgcctccacctccaccaccaccaccaccgccgccagctgcaacaccgacgacctcaacaggtgttaggagggcaacgttaactgcgcgctcgccgctacagatttctacctcgcacgttttacaagaagcccagccaaacacgccagcaccacagacagccccattgacgcccagtcgcagtatcgtagcaaggcatgtcctgcgatgggacgcgctctcacatggtgacatctcccataccgtcttcgacacagaccaacagcatcaacgtcatcctcatcatgctcagtattctgaccgccaatttcgcagaactagtcttgaagaggaacggatggcgacaggagaagacggaacagcggcgttagaaggaaatgaacgacaatcggacacgacgtactatcaaacacccactcaactgcatgatcctacggttcgcaacggagtgtcgtatgcagatgtcgctgcagcgtcgacgtcgggaccgacagagaagaatcccgaagacactccaggctcctctgaacttctacaacctcattcggcacaatcggaaggacccatggcgccaggccctattgaaggacaggtgatcagcttggaacaagattcagatataggaggagaaagtgcaggaactggacccgtcgctccgccgttagccatagagatggattttcaaaagtttgagggtaacagacggctacagcgatgaaagcattctgcctgcacaagcagccacaaaggcgactaattctttcgtttgctgctttagaaatgttctgcatagaccctgtcgaagagcagaggcgagtgaaagccaaggaagtcagcctacgagcaaagtaagctgtttatctacgagccgcatcgatcaagactcatccgtttttagactgaccccgcttgcttgcaccccacattagggccaagccaaaggatgtgaacctgctggatgtcagacggtctacaaacgtctctatcggattatcaagacttatgaaacggtatgagtcgtacgaagcgcttcgctccatggttctttcgcttgatataacagcgacgcccagttcaacgccctcctcaaagtctctgacgctgtacgccacgcccgagtcccctgtgtcgtccgcctctaccatgctaccctcacctttctccgaaggtagccatgaaacggacgcgccctcgtttccgtctcaattggcggcccacaacatattccattcgctcagtcagtccctggcatccccacccccacctccgacccccacatcggccttttcggcgctgtcggctcacccattgttcgcttccagaccctcctcgccaacattctcagtgtcgagcgccaacaattccacaggcaccttcatgacatcccgatccgagacacctattgtatatcagcagcacctaagcctggatgatcttttaacgctggaacctttgctacccacggaaaaggagcgctccgttctcgacgtctatcagcggcagaataagaccgagttcgttgccgatgaggctgaggctatccagaagctgggaccgtcggagcgcttcatgttcactatgtgcaaaccagtcttttcgccactgccagaatcaccgggtactgccgagtcgtcttcgttgcagtgggctaatgctccgcaagcgctcttgaaaggcggcttcaattcattgaatttgaagcgtctaggcaggtcagcatcgccactactttcctctctctcaggcacagccagtaaccaggacgaggaccagctgttgatagacgactacctgtttgtggccatcagcatgctgcgttttgacacggatgtagccgcaacggagacacaggtgcgagaactgatcgagggctgcgacgcgctgcgcacaaacgagcacttgaaggtcctgttcttgggcgtcctcaaagtcggcaacatgctgaacaccatctacggcaggaagaaaccaacgtggcagcagcactactatcaacaccctcagtcggcaccattaaggaataccctgcatgccgccaaatccatgcccaacatcaacgcatcgcagacttctgcttcgtccggtccaccgcctccgccgccgccaccaccaccaccacctcctccagcaaatattcaacagacaagcgcgccagctggcgcttcaggatctcctccacctccaccaccgccaccgccaccacctcctccacctccacctccacctccaccacctccatcatctcagtctggctcctcaaaggcatctcacagcgagatcggttccccaaggcccaggggaccttcgttttcaatgcgccacctgtctgcctctgctcatttacaaccaccaccgcagcctcaggcgcaacagcaacagccgccacatcaacagccacagggtgcagcaggattccgactcaacagtctgttgaagcttcgcgatgtccgcagtttggacaacaagtccaatctaatgcactatctggccaacatggtggcgaataacaaccctgagctgctcaacctgccggacacgttcctctttttgtcaaagctggagcaattccgcaccagggaaattctagaccaggttctggaccatcaaaagacgatacgcaagctggagcagttcaaacaacgcttggagaagacgctgggggcaagactgaaggcccttaaggatttgttgctgtcgaaggcagacttgccagccgctatcgaattcattgagcgagaggaggatgcgctggaggacgaggaggttacaaacgcaaagctcgtgatcgatcgcctggatagatttgtcaaggatgcgcagagtcgatttgaggatttggttgacctggtagaaaaccttgaccagagctggaagtcgacagccatctattttggtgagaagtctgctactgatcatgcccacacccccgaggattctcagtcttcgtcgttggaaggacagcaacaacagcagcaggttgtcaacaggatgcttgttgggcctcgtaagccgccagaggagatctttgcagtcattcatgagtttctgcgacattttcgcgaggctcatcttcagaacgaggacaaaaggatccgggagaagcggcaagcggctacggtcgcgaagcgtgggtcgacctcatccatgcccaccacatcctccaggcgcccttcttcaagttctttgttttctttaaattctgggtcgtcttcgccctcaccatttgcaatgtccttgaggggtggacggacgttgtgagtctagatgctgtttctttgcatttttctacctttagattatatctttgctaatttttcagtgctcttcgtctcattttcctttttttttccctttctcctcctccctctgcatctattgtacaacaaacacgcgcaagaataaatgtgttgaagaaaaaagtcgtaagcgacttttttgttataatcccttctttatctctagattgcatttttttctttttcaatccagacgctgtcgcttattcgagagctcgcccagcgactccttgtcctggacttgtatccgttcatgcagataaggtctcttcccttcaccggctccataatctccagtggcatggccattaccgtgcagctgatatttgtagatcaccaagccctcaaggcccacgggtcctcgggcatgggtcttgttggtactgacgcctacctcagctccgaatccgtaacggaagccatctgcgaagcgagtgcttgcattccagtagacgcctgccgcatccacgcccgccatgaactttttggcttcggcttcactctctgttaggatggcatcggtgtgcttggagccgtgttcattaatgtggtccatggcctctgtcatcgactccactgtcttgaccgcgagcgtgagctccaaaaactcggtgtcgtaatcctcatcgttactggcctggatatgatcggctttgtccttgaacagcgttgcggtcgattccttttgaaggttggccaacgatttgggatcacactttaaggtgacaccatggtcgaccacaagagtccttgcgagctgctggaagaaatccgtgtcgaggtgagaagagtgcacgagaagcgtctcggtcgagttgcaggcggcgggataggtggtctttgcgtcgacgacgacctttttggcgagatcaagctttgctgattctgcaacgtagattgagcacaagccgtctgcgtggccaaggacaggaattctaaaggataaaaacccagcgttaaaaacatgatcgatacagacacaccttgaaaataataagaaaaaagattgacgcaaggagcatgcgctttggtcagatatcttgctgagaatctttttttttacctagtgttccactggatgtgcttaacaagagcattgcttcctctgggaatcaccatgtcgatatacttgtcttgtttcaacaggccgtcaatgtcctgtctcgactctacgatctgcaccgcatccgcgaggttcaaagcgtctgcgtcctcgccctctgcattcttggctgcggccgcgcctgcatcgtccatggcctcccggatggctttggagatggcgctgcaggtatggaaactctccttgccgcccttcaagatcgccgcgtttccagatttgatcgccaatgcggcgatattgaccacgacttcgggtctagcctcgaaaatgacgagcaaaactccgaccgggcacgaaactctatacagttccaatccgttgtcgagtttggtggcctgctgcacctttcctgcagggtcgtccagctgatcaatgtccttgatgccctggagcatggtctcgaacttgccaggtccctcgagatcgagcctcttgtagagcgaggacgataacttgccggccacgacctgttgaagcgccagatccttatcgatcttgttggcggctaggatgtcggacttggcggaggcgagtttggagtggatgtggttgaggaagatggacttttgggctgtggtgatcgtctggaggacattggcggcctgacgggcgttgaacgcgatctgggtgatattatccatagctcctttttttactatgttttttctgactacttcacgggagtgagaaagtgggtttttttctttttccttaagaacagctgtggtatagtgaaggtgaggtcgtgtgctaatcttgcagagaggggggctgtccgaggaggaatggcaggaatgtcgtcggaagaatagtggtagcaggatgaatcagcgtgagcggaatggggtggggacgagaggacaaggagaggggccaagtgggggggacagcggcacaagggccaagtgtgcaatctgaatctacgcagactgactcacccgcaccgtggctcacgtgcatctgggggttcgcgtgggagtgcgcacgcctcattccgacgcgtctgtctcgacaccctcatatgctgcctctgcaggcaacggcagcaagagagctgaacgcgtcagatgtcgcaagctttcgcacccaatcctcttatcctcttaggacgtcgagtcgatcaaacgaccaagggctgaaaaaggagacgaaagagacgaaggacgtgtgacgggatggctgactttggttgatgtataggtgggcgacctctgcgctctgtcatccttgtctccagtggcaaggaacgacgacttgaactctaggggtttcttacgaaggtcttccactcctttattttttcttgtggttgcgagacacaagtccaagacataacagaaaaaaaaataaaaatataaatgccttttcgtcaagcgcgtctcacgcacacacgaacaaagccgtcatcacccttgtcctcgacttgctcttttttttaaaaaaagtgcatccccacaccctccacgcatttaaatgcctcttcgcttcctcgttaaacgccacttgtaaccccatcgactcctcactcccgacgctcgctatctttactcacatagctgctggacggccttagcacagacgctcctgcattcctcttgctggcgcatcaatcacaactactgcacttcaacgagggcgcaagaggtcaaagctcttcccgcgactgaacgctagtccaaacagcgattacacaagatcccagaagatccaaaggttcacacgcacacactctctctctcttacaccattttcctggatttctctcccgctcactcacacacaccctctctcgtgcgtctccatgcactccactctccttattatcgttaccattggcttatggtccgccgcctagtttccttcgcactctccttttttcctcgcgctcccctccagctctcttcttcaaaatctgacgattcgcttcggggtcaataatcatcctgcatagctttctgtacatttttcttccctcactctctttcttcactcgctctccttcttccttcttaacttcttcttaacccctttcggtacttctctcctccttgcaaccacttctttcaacactccagtgcttggcaccccaaaaataatcgacagacggggtttgcgggtagttccctttttttttttatcgtccctcccttttctctcttttcctactactgctttgaggccatgaggtcccctctttcccacgtcttgctcctctggcacgcgatccgtcattcctatctcacacctaacagcccgccgccagcacttggcctgcctgcggtggtgatagccccaccttcgatgcagcctctggcggtcacaccgcccatgggcttcaacaactgggctcggtatgaatgcaacctcgatcaacagctctttacggacactgcagactggatggtcactcacggactgttgcaagcgggctataacacgatcacggtcgatgactgctggatgaccatgcaccgtaatgaaacagactacctcgtcacgaatacgacactgtttccgaacggcatgccctggctaggccagtactttcaccagaagggattcaaatttgggatttaccaagatgctggctacaagacttgtggtggatacccgggctctcagggatattacaaggaggacgtgaacttgtttgcatcctgggaggtggattacatcaagctggatggctgctacgtcgacaggaacgagacccttcctccaagcgagacgcttgaacccaccttccgccaactctacgaggagtttggtcaggcgatccggtcccagcctcggcccatggtctattcagaatcagcaccggcttattttgcagggctgtctgcaggcacgggcgatcgggtgggcaaagactggtataaagtccacacatggatcgggcgctatgggcagctttggaggcactcgaccgatatctctgtctacaaaaaagacggaaagtcacggtggtcgagtgtgatgaccaactaccgattcaacatccggctcgcccgatttcagaggccgggcaactggaacgaccctgactttatcatcacgggcgacaatgaagggctaacgctggacgagcagaaatcccagtttgcattgtggtccatcatggcatcgcccttgatcctgagcacggacgtgaagaacctgactgcagagcaagtgacctttctcaccaaccgcgacatcattgccatcgatcaggacccgctgggcattcaaggacgtctggcctggaggagcgatatcagcgaggtgctcgtcaaacctctgcagaacgtctccacccgggctgtggctgtgctgaacaaacagagcaccatggagaatgtcaccgtgccgttcgcaagactcgggtacacctttccgcccacagctgaggggtgcagccttttggtccgagaactgttctcacagtccgagacggtctacaaggttcaaaatccgcgcacagagtccctcacgacccttctgcctccccacgcgacagcgatctaccggatcacgacattgacaaattatgcgccatgtcgtgtcactgtgcccactggagccatctacctgacatcctcgctcctctgtctcgatgtgtttgagtcacggcgcgatccaggcactgccgccatcgcgtatccctgcaccagcaacgagaaccagctgtggcaagcgtcgtctgctccgccaccgttcacggccgctacctcaacagggattcccacagacccgaacacgctgctttggatcaagaccctcgacaacatgtgtttggacattgactcgactgttgtcactcctgtgcctggctccaaggtcgtcgtgaacccatgtgatgtgacgagggagacccaacagtggacgtacgatccgatgcaaggaactctctttcacatggcctcgggcttttgcgtcgacgcacccaacgcaccctcagggattggagagtcaaagatcaatctgcgactgtggaagtgtggggaacagtccaatagccaagtatggtcaatgcctgcataggggtcctgtaactgtagcgagtgcagcgggagcagcacttccgataaaaaaatgaatgttgtgtacaccatgaaaaaatacattgccttcatctcgaatgtgtctagtgtttttttcacttctatgagctcagtcctctgcccacttgaggctgcctagccaccaaaactttttgggtatcctgccaggacatggcgacagcaccgtaatctttttcctgatgtcatgcacctctgagatataaacaaacccggccaagttggtctccagaatttcggactctaccaatttgtccgcattcgagacggccaggaccgagtgcaagagatgctcgcctggctccaccttcacgacatgggtctcactcactttgcggtcctctccgatcggcagagcagacgatggggcaagtgatccttctcccactctgagcacctcgacatcgtggtagttgaccatggttgagtagggcgccagctctgacttggaggtgccgtaaaaatattcgcggatcttttgcttctgggtctgtcgcctgaaagcagagtcgcgctcgacaactcctccagacttggctagcttaatgaccgagactcccgacttttgatgtaaccgcgtcatgtcgctgtacaacctttcgtgtccaagaacaataatcacgtccactaagatgatcattcatgagccggcaatgtgcaaagggttagctgagatttgctttcgaacacgcggcaatgaaaatgatagaatgatgatagcagcaaggtctacacaccagagaatgcctggatgcagttggcgatgagctcatatcctgtggcgtcgatcagtccgttggtatcaatcacaattcctgatgtgcgggctatgatgttccattaaaaagaatacatcaatacaaggaatgaagaaacgatacaaacaagcctctgcagacatatatccattacctgcttcatcctcttccagtcttctgttcactgattgagccaacctcgcgagcagcaggttgtaaagtttggaattgtccttgggcgaaggaaatccatagtaatatgccaggggcataacagcagatcctgcagtgggtgccgaggttgctgaggatccaaagccctcctccacgtcaatcatctcggtcaggggtgtcgctgtcaaacatccaggcatggttatagacccctataatcgcaatgccaacatattaataagggtcaccaggattgttcctccaacgacaggtgtcaaactcggcagtgcattacctcgctacagtcgagatccacatagataggctggcgagactgcctcaaggcatagctaagcaacatctttgacaacgacgtcttgccaacatcgttcggtccgacaatcagcacctatatgaatgtacatggtcgtgagaatccagaacttgcgtgagaaattttacagcggaccattgaggcaacactttcactggtcacttttgctattgctattcgcatatctgtgttaccctgggtcctttcccattattctgagtagccaaaactcggcgctgctccagtgccagatgtgtattgaggtagctgatcataggggtctcattggcgatatattcgacgctgcatgtgccttggatctgaagtttgcatccatgccatgtgaagacagcgatcttccgtcctgaaaattcatagtcgacgttttggccgagctctgttccaaacacttctgcagtccctgttaccagctgtaaggaggggtcgaaataagatacaaaaaaaaggttgtgtgttattgcatcagttgccaacaaaagtacccgaccattgagctcaaccgcgagcaggttcccttacgcgaagcttgactttgacttcaaagtcgatttcaattcgaagctcattctcctcgtcgaggatccattcttttggttctgtcgttgtcatgctgttgtggcggctgtttctgatctaaaagcaaaagtcgagaatggtcagctgcgaggtccagaacaggaatgcgagtgcagtcctctgtagaagagtctctcgctctgagcttatagaactagaagatggatacctcggaaggaggtgtcgcaggtgctggttgcgtcaagtagattcggtagtcgtgtctgcatgcagaggtgatcaaaagaagcgcgcctataaaaaatgtgatctcagccacaacgaaattgcctgagcaccccaagctgcttgcccagctctctgtcactgccctgcacgcaaatccctctgtgtagccctcatcggccttgcatcaaaggtatatataatcatttgcctctgccggtcgttgggcttgactgcctctgcttcgccatcaggctgaagcctccataccaaatcagtattttccttgacgagagccacatcaagactgcgttgatgccaaggtggtattggcgtctgataggctgtgctgaatacctgattcttggccgagagaagatcgatccatcttcaccgtggtacctgatcgcgtcttcaggcacatcaaagtagcatgatgcgaccaaaactgacggggtgtggcctgatgttggtcgtctttgttgaactgcatccaaatcggggctgcgactgtcgcacaggtacgtagcaatctaggtgacggagatcatttcggcattctgcttccttttgctgtctcggagtactgcccaaatagtcattttgcgctacagaaaaaatcaacagttggtttcatcattgacgcggaccactcttggagcacgcacgctactcacactcccttgagcaaccttgcctgatccatgcagagtcaacggaaaagtggatccgctcgagtcggtgtcccaccttggggtgcaacgacctgaagaccccatcggccccgccctacacttataaaggccagatcgccttaccgcagaggcctcccttttctattttcctctcacttccacacttacacttccccacttctggttacgttcacttacccgcatccatctcgcacagtcagcaccatggcccactttgcacggtccacgacattgcgcaccctgtccagaagtggtatgtggtcttggaatgtcaggtcatgaacactgctgtctccatggaggaaaagaaagtgaatgagccttccaaaaatgttgttctgaacctgtttcgcaccgtcctcctctcttctttttcatgctactgtcccttggaacagcttcattatcatccgctaagacgtatgttgaactctaaaccgcccacgcactcgcaaaaacgattttgcagaacgaagaaagaaaagagtgcttactttaccacattccagtccatggtctcgcatcggccgatcctactccactgcagccaaggctgtttctgtgcggtcgtctgcctcgatcgctgcattcacaacccttggagctgctgccgccgcgacagcttactggagccagactcctgttgtaagcaccgcttcatgtgccactgaggatcagtccttcctgtagcttccaataataactaggtcaaaaccgtttgtggtaattgactagtccaagatcgattgtgaagccccttcaccaccaaccccaaagataaagagcatcaccgctcaagaagaccagcagcgggtaagttcagaagcggtatctcatggattcaccttaagaatttgacccctccctcgcgtccgtagcctttgtactaatacctcctcgcagaaactagaaggtctcaccaaagactcgcccatgcgcctgcgaatggaagagtttgtgaaacagatacaggtcgagatcacctccgagttggagaaggtcgacggcgaagccaagttcaaagttgatcgatggaccagagccgagggaggagatggcatctcgatggtaatgcaagaaggcaaggtctttgagaaggccggcgtcggcgtctcggtcgtttacggcatgctgccgccggcagctgtcgcccagatgcgtgctcaacaccccaatatcgcggccacaaaggaggacactcccttttttgcaacaggaatctcggcggttatacatcccaagaatcctaacgctcccacagttcacttcaattatcgctactttgagctcggtagtgcagagggcggtgaacccgtgtcgtggtggtttggcggtgggtgtgatctgacaccgacgattctctatgacgaggacgcgatccatttccacgaggtgatcaaagaggcctgcgaaccccacgatccacggtactacagggactttaaaaagtggtgcgacgactatttctacatcgctcatcgtggcgagcggcgaggcatcggtggcatcttctttgacgatctagatgacaaatctgcagacgagctctttgcgtttgtccagagttgtggcaaggccttcacgaagcagtatgtccccattatggagaggcgtaagaacatgcccttcacagaagaggacaagcattggcagcagttgaggaggggtcggtatgtggagttcaacttggtgtatgaccgcggcaccaagtttggactgctgacgcctggtgcgagaatcgagagcattctgatgacaatgcccctgacggcgcggtgggagtacatgcaggagccagatatgaagactcatggcaagttaatggaggtgttgcgatccccaaaggactggatcccatcgtgatagactgcacaacctgataaacacaagacattgtctcgcatagaaccagaacgttggaaaacggtggcaaagcacggtcatttgtcggcgaacagagtggatatggggagtgatgtactttagtaatgacatataaataaggaccaagaggccgacactgagcactaaaccccctcattccctcatctctcgccaaaatgcagacggatcggatcgccgccaaatactccaacgcaaaatcaatgctcttactggaggtacaagaacaaacgctaattgcttacagctgcgttgcagccagccttttctaacctttgtctcccctccaatgattgccaggctgctggactcagtatgacgttcccagggacagaaatgctcttgctcgtcgcgtttttagaagagaattccctcatatatgacttcaaaacaagcatgtttgcgcccattgtgacgcatcctgatagcaaacgtttgataatagagtacctctcagcccctgataccgagtcgtcaaatgtaagtttgaaccactgtgccctcgttggtcgatgtttgcgaccgctttgtgtattgaacatttaggctctcttcttcacttacaaggacaaagaagcacctgaatctagtaaagccgatgatggtaacatcctaaatgaggtacccatgttcaggttcaagcgagcagaaaacggaagtatggcgattatggatcaggaacgatatgacctgctgttcccccagttcaaaaatcatgtcatgcggaaggtaaggtggaatatgatgagtgctcagaaatccactgcgaatcacgactaagagtggcgtttcaattgctaggtcgtcaaatttagccagattccaaaggctcaagttgtttttttggtgtcgaatggcccaggtttggtcgccgcttttaccacgcccaagtttctgccccttctaacgcagccagagggatggggaacgatcaaagcatgcctggaaacacctgccaatggcgagactattgcctgagcgctcagacctcaaagcactttacaatgaaaaaaataaacagcttcagtttcgtatcttagcacaaagggcgtacagttgccgacgtgcaggagggaaacagtggcaaaccacaggctgtaaatgtacagtagtacagtacatgtatttgtatacttcatgctggtgactcgatagtttaagtagagccagaagatttcatcgcacagtcgttcactcttctttcctcccaccaaccgatgacagataatcgctttagcgacgctgagaaaatcattcgctctcgaaagagaatgcgcgccttgaacgctgtatgtggccaagtggcactgatatcatgttgtctccaggtttcaagactatcgcaatgcccatggtttctaatttcattcaccctgtcctctgaactgaatgaacgctatttaggcacacaacgtgttacggaaagcagatgtgctcttcctgagcgcaagggcgggagtgacccctgtatgttattgggccacaccgcggttttggcccctcataagagatcccgagaataagagcctcatattacagctcatggaaggatctgacaccgagtcgatgtctgtaggctgatattccttcctctctgcatgaacagctcgagcaccgtgaatcttgacagtgggtgattaaagagccgtatgaactctcctttttcaataggacgctcaatcaagtgctgcctatcaagacgaggtgcccaagtttgagttcaaacgtgcaggactaggatatgcagcgatcatggatcaggcgaaacacgatgtgctattcccacagttcaaggcgcgcgcattaggagcggtaacgagaaatctatgtctatgaatgtgttttcaaaggctcgttgatatcgcaaagacttgtattcatcaagatgacacttcattgctaggcaatcgatctgagcaaaatcccaggagaagaagtgctgctgattgcaacctctggaccagacatggtcgccgcctttgctactcccaagctcttgcccttcttaacacgacccgaggggtggaacgctatcaaggcgcacctgcaagcgccgcttgttgatatcaacacatacgacttctttgagctgtttaggctgtgtagcgttgatgccgaacttgacagtaggggaaacattttgagctggaatccgacccgcacaccataaagcagtcattgttgtggatttttttttctttttttttttttatggccatgatgcaaacctcgcttgagtttcgccacttccctgtctctccccacatcaactaatacacatcatgtccccgcgcaaaagtatgtacaaagacaaaaccagcactcttctaccgtccatcgcttcccaaccgtgcttgatgcccgcgccttctcgatggcctcattcttatgaccttttacccctcatccgttgcaatagagattacgtccaagagaatccctgctaaccacaggtacaagattgagaagcgtgtcaaggaccatcaccgcaagcttcgcaaggatgccaagagcaaacccaatggtcaccacagtacgtactgttactgctagcctgacgcttctacacacaagcagtgctctggcgtattcgatccatcagccttatctttctcttgcgagtttttggatgacaagtcgctaatagcttgaactttcttcccgtagaaaacaagaaggatcccggtatccccaacaacttccctggcaaggagaagattttgcagcagattgcagatcaaaagttgaaggcccaggaggagaaggataagcagaaggagattcgcagaaaggcagccgagaaggcccgcaaggctaacaaggccaggaacatcaaccctgctgagccagcaaaggaaaagaaggcaaaggaggctaccagcacagagggcgttctttccaaggcagccaagcgtaaggcaacagctgcagcagcaacatcgtctccagcaacaaaaaagactaagacgaccaagaaggccgctgccaaggaggaggaggaggacgaggaggatgccgatgccgatgcaccctacagctttgcagagcactttgtcagcggagagggcgatgaggaggtcgacgaggaagaggcagaggcagaggaagaggaagaggatgacgagtaagacattggatcttccttttagctcccccctctctctttatttctcacccttgcagacacgcgtattcatggcctgtactcgccgtgcttttgtactatttttcatctaccaatatatgcatactttcattccgtgcctgaggtgtcaaaatgtcagcttgaggttcggccatggccctaaacagtcacttgccgcgcgcggccgcgaattgttgtgaggtggctttttatgggacttccggaccttgcgtagcgcctgcctgtctccactaccagcgttcctgaattcgctttattccgcattcatagcagcaaatcccacctcaccgcacatcatataaaatggcaagcaggacagcattacaacagcttctgtcaaggcgagccttggcttcccttacgccctcaagaactgcgggcttctcgaccatgaccaaggtccttcaccaacagcaggctcctcgtagtaacgacagctcctcgtccggcagcagcagtacccagcccgagactcatttcgggttccagaacgtccccgagaacatgaaggaggctttgggtatgtcaagatctacctcctcgccgccggttgccttgacgcgatagtactattccttgctgactgtccttggcaaaaacggctttgattcacctgatttggaaatagtcaagcaagtgtttgcgaacgtggccaccaagtacgatgtcatgaacgatgttatgagtggaggtgttcaccgtctttggaaggaccatttcatccgcacactcgcaccgactcccggaaccaagctgttggatgtcgcaggcggcactggtaacatctacttgccctctgttttttttctctgctgatcaacgtttctgaggaaacgcgcgttactgcatgagctgcattgccttcgtctgttcactgatttgtttgagatatggttactgtgacaacgcgtaggtgacattgcaatgcgcttcttggactattgcaaggaaactcatggcgataactctgctcaggttacagtgttcgacatcaaccccaatatgttgcaggtcggtcaggagcgattcgcaaagaccccataccacaacagtacgtccagcccccttgattttctttcacagttgtagaacgtgcttggtcctctaggctacacaaaactcatccatcgacttttgcctgcatgtgctattcaatacgattcacagcttctcaagtctctttcatggaaggcaacgccgaaaacctggaacatatccccgacaactcaatggacgcttacactatcgcctttggaatccgtaattgcactcacgtcgatcgtgtgctcaaggaggcccacagagttttgaaacctggtggacgctttatgtgcctggagttcagcaaggttgaaaaccctgtgatcgccaagtaagtatttccccctcccttgctagttatcaggctgaagtgttcagtgatggtggatgaggtctcctttctaaacccctcgttttaccttcatagggcttacgatgtgttctcgtttgatgttatcccgaccatgggtcagatcatcgccaacgacagagactcgtaccagtacttggtcgagtccattcgcaagttccctccacagaaggaattcgcaaagatgatcaaggatgctggattcacggtcatgggtcaaggttacgaggatttgacctttggcgtcgccgccatccactctggattcaagctgtaaattttcttctcgatgcattaaagtggtgaagccatttttttcttctatctccccggaatgatcaggcgaacggatattgtacaactgtttgtttgtttgtttattaggcacctaattgtacgacatgtacttgggggtcgaactgaacttggcatacgacttgatgaccttgttcacagcctccaaaaagtccttctcagtcgccacctttctccttgcacgaatcgcaaacatgcccgcctcggtgcacacagaccgcagctctgcgcctgtgctgttggggcagagtctggcaatcaactcgtagcggatatcacgctccacgctcatggatcgtgcatggatcttgagaatgtgcgcacgtccctccagatcaggaagtgagaactcaaccttacgatccaaacgtccggggcgcaacaaggcgggatcgagtgtgtcgggtctgttggtagccatcagaaccttgatgtttcctcgcgagtcgaatccgtccagctggttgatcagctcgagcattgtacgctgaacttcgttgtctcctcctgctccatcatcgaaacgtgctcctccgattgcgtcaacttcgtcaaagaagatgatacatgcctttttggtcttagccatctcgaacaactcacgcaccatacgagcaccctcgccgatatacctattagaaaaaaaaaaaaggttagcaaactgtatctctgagcgctgaagagtccgtattgtggtcgccgttgaatataatcttacttttgcaccaactcagatccaataacacggatgaatgtagcatccgtacgattcgcagcagcacgggcacaaagggtctttccagtgcctgggggtccatagagcagcacacctttaggtgggtcgattccaaggttgacaaatcgctccggctgcagcaagggcagttctacgacttctctcaacttttcgatctgttccttgcatcctccaacatcactgtaggtcacgtcaggcttttcctcgacctgcatcatcgtcacggacgcatcgatcttgggaggcaatgggatctggatgtggtatttagtgcggtccactctatgaccagaaatagaaggagggtaaaagcagctcgtgtgagagattgatccccaactttgaaagtggcatgcaggacaccatcattcatattcagtacacatacccgacacgaatgccttcgtcgatatctgtaggcgacactttctctcccagtccgacgacaaatttggcgatctgcttgacgttgatcacgtactttgcgggctcatctcccacggcctcgatgatctttgtgcatcgtgcgacctaatacaacgcgtttcagaggagccatagtgtcaaaagatcctgttagtccaccatgggtcgcgatccatcagaagcccagaaaaatggtgataaagaccacttgcctgtagtggctgctcttctcccatacgctgcttgtccgcagggatgtcccacaatgctggaggcgccaaacctgtatccgactccttgactccgatcttttcattcacacgtttctgggcgtccttgatgtcgctctcaagtttcttcaagtccttggcatatggtccctgaccctgttttggacatgtcccggcaagaagagggtacggtgtcagtgccagctcgaacttttgttgcattgcaatttttttttctttgaagtcttgaggtccttacgtaggttttcaagagggcaatatcgccttcatccaaagcgacaatattctcctccttatcatcgactggcttgtcgtctagataacgggtgaaagtggcagggtatgtcacaacaagcaggtgtcagcgtttccttttcaacaaccggtacatgaaaagtgacgcgaaacttgttcgtcctttgagtgcatccagttgccattacacttctcccagttttcctttggtggtgccatggctgtaagtctgattgattcgtggtgttcttgcgatgttgatggctggaatgtaaaagaaagagcgtgcgagggcagaggattagggtgatgcggagtgaggagcaagaagcgacgcgcaacgctcgccctcgttaaaaaaaagttacacgtataggagatacattcatcgtacatacaaccttcatatgatatgaacgttaaatcctactccacccctcgaacacctcccaccacattcacgactttcgtccttacattcaaaataaccacaaactgtcaacaacttcaattgaaagaaacattttgacgaagcaagttcacccgacaaacaacaaactgtggttatgtgatttttgatccatcttgataccaacgccaggagccagtgttgcatgggagccatatcacgaaagcaggtacaggtcgaggcaacaggttgtatgttttttggatttttttttaataaaagtacaatgctggtattaagatgctctagagaattggtgccggcttggatatatatacaaccttccgtggaagagtggagcgagtgctgttgtatgatttgaatttacttggcctcgataggggtcatgccgcgggccaagatctcctcgcgagtcataccgcgctgctcaatctcctcaagagacatacccttggtctcgggaatgaggaaggtgcagaggaaaccaagagccatgactccggcaaagattccgagcaactggggcaagaaagcgtgctcaccaggggcaccaccgatctcagcgaccttgttgaacaggaaggtggccaagatggcaccgagcttgccagaggcggcagagataccgtgggcagtggcgcggacacgggtggggaagacctcaccggggacaacgaaggtggtagtgttgggaccaaagttgaagaagaactgagccagggtgaagacagcgacaaagagaggaacaatcttctggagctggtggaaggcagcggagaggatgacgaagaggatggtcaacatggcaaaacccatgaactggatcttcttgcggcccatcttctcgatcaggaagacagtgaaccagtaaccaggaacgaaaccgaggagggagacagtcaagttgccgagggtggttctccagaggttgtcatagacggtaccgtcaccgtggaagcccatggcgttcaggacataagactggttaagagagactccgtagaaggcgatatcgagcaagaaccaggtcgaggaggtaccgatgaggacctttaggttctcccagcgagaaaagtactccataaagtcacggttgtggttgcgtttggccttggcatcagcgacagcgttctggttggcaaggacatcggcagcggtgttgttgttctcaacagtggtctcggtggcacgggcaacagccaagttggccttctcgacatcgttctcgacgtccatggcataacgaggggactcgggcatggtcagacgcaagtagatggtggagacggcggggatgcagccaataccaatgcagacgcgccagacgtagtccaggttgtcaacatcagcgatgatggcactcttgaagcaggcgaggatgataagggtcatgactgaggccatcatgttaccgataccctgcatggagaagatgatcgacatgagctgaccgcggcgaccagcagaggcccactccgaggtgacagtggcagacatggggtagtcaccaccgataccgataccgaggatgaagcgccagaaagtcaggtactggatgacagtggatcccttggcgttagagccggccatggcacagcagaaggttccgagaatgataatcatcaactccagaccgtagatcttctgacgaccgtaagcatcaccgaggtaaccaaagacgagctgaccgacaagagttccgaacgaggccatacccttgagggcgccctcagtgccggagggaatgtgtccgccgctctccttgaagtagacatagccgagcatggggacgatcaagttgatgatgaagacatcataggcgtcggtgaaaaaaccagttccagaggtgatgagggtgcggatcgtgaaccagttccaagattgctgctcctcgagattggcaagaccacccttgggctggacagtgccgtcgatggagccagtctcggggacgttatcagcgacgtccttttcggtgaagttggaaggaccagacatgatgagtggtgtgtgtgcgaggatgagaagggaaggatgaaagtctgatcgggtggtgaaagtctgacagacgggtgagtgagaaggagacaaagactgctggagagagtagtgaggagaaaaaaaaagggccaccaggagggatcggaagatatttatacacactgggtgtccctggccaaaggacagagggtgtgaaatatcagctcttatgataggagacacgacctcagatgagtttgaacccaggaacaaaacacccgcaaatggcggtggagagggatgcggctcgcgtgtggtcgcacaggagcagacaagcagcccaaaagcgtccttgcgcgggtcgagtggtcgattgtgcttgctgagatgcaaataacgtagaacttcccccgcagcgaatcacagcgcagaaaagcttctggttgtacaacgacctcgcagccaatcgacagccacacgtgtgggagggggcatccaatgaaatcccctaccaagacagcgtgctgcatctcgcgcttttgctcgccctaaaccctgccctgtggagccaatcattttcgggtgctagcagagatgggggtgcagctgaactctaaaaaaaaccacccaaaatactctacaaccctcttgcatgcgacccttctgcccttttggttcgatgagtcttctcacccttccttcggggagtgcaaatttttcaaaagcagacgatgcataagccctttcacgcactcgcttcccaaagcagacgatcatgacctctgctgccgtaaatgtcgataaaaaggtacccctctgatcgaaaccactccctatttttgacacagtcgacgaggtcgaccgcggacaacaataaggggcaaacaggagtcgatgaatggtctggattgctgtaaaatatacccataggtctcatctgctagattacagtactgtaacactgcgactcaaacgcacagggaaaataaaggcttcttgctcatccagacgaacgtcatgtcagagcaaacaattaatcctgtgttgttgtggagctgcaagatcaaagcttggtctgcttgccgtagtctaatcgactccctagtgcggtgctgtgtcgcccaaagaattcacgtttaacccacacgtgtggacggcaaacatccagaatgcgtgatttggaaaactctctgcgtgagtattggcttcgaggtctcgtttgacccaatgaggaagtgctctccgcagcctgcgttgcaaagatcgatctgctctcgtccctacttccgacatggtctgatctcctgttgcaactcctctgctttgatttcacttacagtagagtcgtacagtaaactatttcgtttcaactcacaccagcaggttggatcgttaatataaccagacaacccgcagggtgcttttgaggtcatttccagtcgagtttcgcggcctgctcgcatctgaaacggccagggcttggtgtagagcacgttcctaacgcaccgatagtttcgttccacttcttacgttcacactcgcacacgttgtttcccgacggcagttgtagagaccctgagatttataggcgatgtagtctatatacgttgtatatgtctacgcgtctagagctctttccagtaaaggaccttcccgctttcgccacccacaactgcatcgccacccttgaagccgttctttagcaggaactgcaccattcctggaaaggcctgtgggatcgtgtggaccgtcatgacgcccgacccttgtccactgctcttccactccagcacctccttttcgagctgatcaaggcatcgggacattaagcgatggcgcctctgttcaggatctgatccacagagccagatgtgggtaacaccgcttgcggcaaccaggatttgcgcttcaggtgacaactcttgacccggttgtccgttgctggatgggatcgtcttggggatggaaggtttgtggtgggcaaacagaaaggacgtgaaggcctccttttgctggtcactgggggtgtgtgtagtggcgtagaccagtccagcttgtgacactgccttcggtggaagtgtcaagacatcaacatagtcgtcttcggcaggcgaagtgcgagtcgttcctgcatagatgcgacggtgccactctgacatgttgcaagtctttgacacgtcgacagagtcgcccatgcccatctgctggaactcggtcatgaagaggatggttgaaaacattgtcaggttggcgagcgatatctctgcgggcatctgcgtgcccttactggcagcattgtcgctgctgtcgtccgagaccagctggatgtctttgtgggtgaatctgtacaggcggaccatgatgtcgttgtcgttttgggctgatctcaataaaaatagaaaacacgaaaaagatatgggctttagtgactggcaccgcacgcatatatctcgagacgactgcgacgattcctttcgctctttcctcttgaccgccctgctctgttcgttgctgcttccgctgccctatcgctgtcactccatcatcctcgctgctcctgctcggcttcgcgcccctcgcctcgctcatccctgcgccctgcaccgcttaccgaaacaagctgctctctcctgcgcacgcgcccgctcccactcaactcaaacctcgtagcaagctgctcgtcgctcgccctaggcccagtccttcgctcatacccttagcagcccttctataccatggtctttcatgctacccgaatcacgaaaccgcaccttgctcgggcgtctatgcgtccagtcaaaagcaaccaggacaaggagaatataccagcaacgaagccggaagtacgtacggtgtcttatgtcttctgtgttttccacaagcaggactcgcgtctacagaaactagagagcatgccgccaacactactttttttttcttgcatatctgactgacattccactccctacgacatattcttagaccgtcggtgagagtagcgatggacagcgagctaaacgactagttaatgtgcaggctcctacggccactctcctatccagtcaacaccgcaaagtcctcacgactcacagctcaaaccgcgccgccagcagagccgacaccgacagcacgcatgcacgcagcgggagcacggtctcacggaacccggcaaagcagcaaggccagctcagtgcacccaagaaggagacatcctcgctgaagccgggcagcagtcgtagggttgggagcaggactatcggtgtcgttgcaaccgtagctagcactaggatcacaaatgctggcaatagggactcttttgggatcgacaagctggagatttatgacgacgcgacctcgtcgtctcgcccaccgcaaggagagcgcataaaaggcagcctccctccccgatcagtgaacactgctgacccctctggatcctccacagcagctcataacccggcaaagactgagcctgtcggtactgttgttcgaaaactcctctctcgtaccgttccgaatccgatcctggttgagagacagagattggccgctgcccctactcaaaaatttgtgtcctcgcaacccacagctactgcagctcgcggtcctcgcgcacaagtccaggagaaagtcgaagattcggagtgtcgcgattcgacgggtacgacgcttgctctatacgacactggcggcatacaaaagcagaaagaactcaagcgaacacgggtggagacggacgatggggacgatgcgcccgcagccgtcggtactgcaagctccgcccatgacgctcagctcaaatcggacaagcgactaaaagtagaagagttccaaccggaccacgatctacagactttcgatctctcgctagaaggcgagtattcggcggatatatttgcatatttgcgcgagatggagatcctgttagcccctagtatcggataccttgagcgcaggtcagacgcgttctggatcaatcgacagtattacgtcaacaggttagccgggatccatggcaggatgcaatcgaatctggagaccttgttcctggctgtcaacatctttgacagggtactcagcaaaaaacaacttcaaccgcgtcgaacatataacaacgcagtcatggcactgacttgtttgctaatcgcatccaagttcgaggagcgcaatatctacgcaaacatattcatgttcattcgcttcacagacctctttgacgaccgataccccgacaatgacattgatgtcagagccttccgggattgtgagcaagatttactccttatgctcgattacaagcttgggtggccaggaccattatcgttcctgaggcgatgctcgcgtgtggacgagagtgaattcacggcccggacgatcgcaaagtttgtgctcgaggtcatactgaaccaccatgctttcctggtctacaagccctcgatccaagcagcggcagccatgtatataggtcgtttcatattgggacgaaagacttgggtaagcgctttcactcagacccctctcccttgccgtcctgacacccctcaaggtttttttagaatgacgttcttacatgcttcgtgctcttttttcatccggcatagagccaaaccatgatgaagtactctggatatacgctccaggagttggaacctgccattatggacgtgatttcgtttctgaaggacccaattgtgcccacgacggtcgcctacaagaagtacagcgccaagacttattcacgcatatcggcctttgtcattgaatgggctatcgacagttcgttcagctccgtagtacaacgcaccgtgacattgcccggctcttcagcaaccgcgcactccagcatcaacagtgccagcaccggcctctagactgtcactctgtagctaccctcttctggcgcatcctcctgctgtcgtcgcccaaaacttgaagcagaagaaaaattctcattccgtcgctggcgcttaccgctgcctctgccttgttcaaactgtatgtatagtatttacagcaccttgctctcgtagacgagattataattattatactctgtgcctgtgacctagggtcgaattgaagggtccgcacgagaacgctgtattgaaccaaactccaagcggtggatcagcagggatgatatactacacattaagcatcattctcttatatcgagactctgctcttcaagagtatacattcttcttgcagctgctagcgaaccgaacgatcaagtctctttgacaagctccatttttttttatcgtcctacctaccaaatcccgccgagatcgtttcttttgccagtggtccacctatctatccatctccatcgttaaatcatgtccttttatcatactataaacaactcacgttctctgcttatgaccgcgtccaaacttaaccctgggcgatctttttgaaggagagcgaagaaagaaaaaaaaaaaaaaggtcaggcacgtgaaccctcatatatgagaaactaacctctatagatgtaagtaacctccgtaaatgaaagatttgttcaatgatccatgtagttcctaaaacttctaactccaactcatcccggtccaatcggaatgcggccctcttcctcttaaagaggttgaaagcccgcttagctcattggtagagcgtctgcctagtaagcagaaggtagcaggttcgatccctgcagtgggcaattctttttttcttttgctatttcggactcgcttcgcgaggttttcgccactcttttggcggaaaaagtcaccagctcttttgcagttttcagttaggagtgatctttcacacaaacaagcagagtgagtcgtgatcactttttcgcgaccagtgtctccagtgtctgtgggttcaaaggacggagtcctgtggtgttttgtcacgtataaaaatgatctcattgttgggtcatttttctcacttcggggggcgagcaacgtagacgtttctaagtcaactttgagcgcaatttgagaggaagattaagaaagggggggcgagacaaggggaaaagagagtgtgagagtgtgagctgaagctcgccgttgcacttcttttgagccttcaccgcaaactgggcaggggccacaccaaaaaaaaaaaaaaaaactgcacggatcaagtgtcgttagttttatttccctcactcgcactgcactcactcactcatgaggaagcggctatatagctatatacaaaacgccaaaacgccaataaaaaatgggggatgtgggtggtgatgacaaaaaacaggaacccggtatatgaccagggggtcaggctaacaacaaaagaaaaaacggagaggactcaagtttttcatatctggctggtgaacggtcctgctagggcgttcgaaggaggcttgagaacgaaaggttctgacgacgggtcgttctgccctgcctcaccgccattggaaggagtctgtccataccccttggacgtatctctcgccaaggcgttggcagagttgtttgcgtgatcaattccggccaaggaggatgcgaggaagccgccattgccgttgccattatcaccgagagcaccgccattatggtggttctgactcggctgggcagggtgagcagcgttggtgctattgagtgcatgcatctgggggggcaagggcttcgtctgttgttgatgcagtgtagggtcctctgttgaggtggtcgaagcgcctgaggctggcccgggtccagctagtacaggggcaggcgctggaatcgtcgagaactcgggagcggtcggcgccgctggtgtggatagcaacggtgcggcgcttgtcgctgtcgcagtgttttgatgaggctcgtccaagacagtatcgagctcgggcaacggagcgaactgaggttctggttctttcaccgtttccaacgctgcagtgatgctgtcgtccttgacgggcgctaaaggcatggtcgtggtagcagtaacagaggcagaagcaggagcaggaggagcaggagcagaggcagctgctgcaacaggaggaacaaggtcttttccttgaccattgaacgacgtgattgtggaggtcccaccatccagaagaggcggaacttcttgaactggagcagtcgatttcaagttgccgatagcaggcgttggcgcgggtgcggatgggagcttggcttccgcgctgaggtccgagtctaggtcatcgaggccagactttgtcattttcttggggacgtctgctgttgtggacgagtcgctgttcttgcgcttgagctgagcggacgctgttgtagggaggtggcccgtggcagtatcgagaccaggctcgggtttgatgcctcttgagcgcgtcgtgaccattattgcagcgggtgggcggaaacaggcgttgggtgccgtgagagtgcaggagagagcgaggaggaaaggagagtcagatatggagagatagagagagagtcgactggaatcaggtggagtgggaagagcagagcaagagtaaaacgaagagagagagtgtgtggaggggggggcgtgatggaagtgagagaagaagcaaagagagaagtggaggcgtgaggtgaaagaggagtgaggacagaggacgagagtgagccgccattgtatttgtacgtgtttgacacaaccgtataaattacatagtatctatgacataaggcccccttctcgcatgcaaacgaatagcagaaagacagagactgtggagagcgcctcagaactgtctgtttcagtgacatcgaatgggtccgcctgtctgtatgttatatacattctgcattttattctgccgaacgcggcaggctattcagcggcgagggggtattccaaacatgttcacctcgtcccttgtcgagtggatccattcgcgcacaaagatcgaggccttcatgaagcgcttggtcgagtacttgcgaaagataaaggactccaccttgacgggcttgcgaaggtagaaaaccatcctctgcatacatgggatcaggtcatcgaacgagtatcccgagtaatgtgtcaggttggcgtcccattcagattgccccatcattcggcgcgctagacaaagcgccgctcccgagatcatcgacggtgcgcactccagaaaattgtggtccaaaagcgggatttccatcaggtacttggccaccgtacgcgaatggatgtcgtagttgtctgccttggaaatgcggcgcaaaaagttcatagggctaggatagcacagcttgaagttgagggccgtaagcatgtaccgctctgcctccagtatttcttgatcggtgaatccgccatcggacatgtagataaagttctggaccgagggtgccatgacctcttcgtatttggacgcaataaacaacgccgtcactccaacaagctgaagcttgaccaagttcacggtccggcacgatagaaagcgatcaatgagattgacagaaaggaacagtgtctctggaagcaacttgaacttgttatgaacctccgccagccagtcaaccaaaacgcccctcatcttccatgccaaatccttttgcatcttcatgtagtttggatctggcatcgtttcaatctacaaacagaggcaagaatatgttagttcaggcccatgtttccgtttttcttttcgtttcatacaggttatgaagaccgatagaccgagagggggggggggggaacactttacctccagatcctgcatatagctgaaaatctccacgacatactctgacaccatcaggggatcgagcatatcctctgcgtcgagatcttcccataaaagttcctcggtcttgcgacgcttattctcttcctcctcgtgctcgcgtgcatgcagcgcaagctcctccctttcgtctgtccaccttggacccgtcattataggaggcagggcgcgctttgacagcggcctcgttcccgtcgactctgttttgatttccgattttatctcccgcttaatttcccgcttaatttcctgtttgatttcctgcttgatatcatgatgaacctgttcctgcttgatatcacgaaggatgtgctcttgcttgatctcatgctggaaaggttcctgcttgatctcctgcttgatgtactcttgtttgatttcctgcttaatgaacccatgcttgttttcttgcttcacagaaacgttttggtccagttggttaacctcttgaagaattctccttgattgtggccgtgcgtgtgctgatgttgcggctgagggctccctcttcacgggtgcgagaccagcgaatacgggctccttcttgacgggcgcaggcgcagcgaataccggctcttttttgacgggagcaggtgcagcgaacacaggctccttcttggcgggtgcatgtgctgcaaaaaccggctccttcatggacggcgcaggtgccgcgactgacggttgccactggacgaatccatcgggtacagtgtccctcttgacaggcgcaggtgcattcgcgacaccatctcgtctaataggcgcagatgcggtagatagaggatttggccgggccaggcggaatttgccgaaggcgggctttggcgcattgctactgcttgagttctatatccatcaaagaagcaaagaagagaagcgatagctgttagagtcggcgaagagaaggttgttgtctttcgttcggctcttttttttttttttttttttttttacaaatatacgaaggacgcgttttttttcgatgttttgggacgtgacaactgaaaaggacaaaatacaaaataaagagggtggggtcgattgcatcaagaacagagatggaatattggtgtagggagtgacaatcacgggagaacattactgagaacttacttccttgtcagccgtgttggtcttttcaccaagaacccgctttcttgaggccggagcagctgctgtggtggtcatggtggacctgcccctggaaggaagcacggcgctgatggcatccttcacgtaggtgacaggctgtggcgcattggcgatgttttcgctattctgatggcgctttgctatcaacagcggtgctcgtgggcgggatatctagttgggggagcagatggattttttcgtatcaaaaaacggcaccatatgtgtgttggcagtgattgagtgagcgaaaacaatcagcggagacacgtacaggctgctgtgacatgattgctatctattttgtttggtgcaatgagatagaaaaaaaaagggcacttgctggcaatctctacacgagcagagactggcacaaggaggagagtgcagcagcgattccttgattggtatacagtaggcactggtataaggagacaatcaaaagaacagaaaaaaaaagaaaacgcggcgagcgtggcaagcggaaggcgaagcgaagggcgatggcgcggtgatgcagcaggccaagggcggggaggaaataataataacagtagcagaagggggtatgactggagcactgaggcagaggcggttgcgaagcgagagaggcagagaagatggagagaaggagcgaaggagcgaaggagcgaaggagcgacggcgagacggagagatggcgtccgagggagcaaacaacacggcctgtgggatgagcgggacgtgagagtgccaggcaggtgttgggtgcgagtgaagagagagaggggcgacacaaacaggagcaagagacgagcgacggaaaaaaaacccttgcttacggggcagtaaaactgctactgtacaaacaaccgtggcctcgatcgcatgtcctgcggtgaggtgtcttcaagtttcaacaacgcacgccatcacgtcttcctgcttcagacactctcactcaacacacccacccgcagccgagtcgactgtaatctagcaaaagatttcctcttcctgcatcccccaccccctcgtctgtacactaacaaaaacacaagggatcagggacagccagtcgttcatcacaggcaaacgagaaaaagactactttttaaagaaaaacgaacaagacgagcaacagctttgaaggagcgatgcattccatgcaaggacaacatccttccaacttgcagtacttgcagcatcaggctgctgggctctcggctcagaacagacagggaggtggaggaggcggaggcgggggagctggtagtggaggaggaggcggtatgcacggcatgggacctaatcagatgaactttggagcgggaggactcggcaacatgagcaactctcaactggccatgcagctccatcagcaacagcaggctcagcagcaacaggctcagcagcagcttcagcagcagcagcaacaacagcaacagcagcaacttcatcaacagcaacagcgacagcaacaacagcaacaattacagcaggcccagcaacagcagcagcagcagcagcaacagcaacaagctcagcagcaacaggcccagctccagcaggcgcaacagcaagcgcaacagcaagcgcaccagcagcagcagcagcaacagcagcagcaacaacagttccgacttgctagcatcgatgacgaaaagatctaccatctcgtcttggagctcacgaaccccgtcaaccgtgaacaggccctactggagttgagcaagaagcgcgagcagtttgatgagctggcactagttctttggcactcctttggtaagtcgatctcgcatcaggtctgattagatgttcaatgttcggtgtcagagatcatggtctaaccgcgtcgtgtctttccttgcattgttgtgtaggcgtcatggctgcactgctacaggagatcgtgtctgtgtatccgctgttggcaccttcgggattgaccgcacatgcatccaaccgcgtatgcaatgctcttgcgctgctgcagtgcgtggccagtcacccagacactagaggattgttcttgaatggtaacacttttggtagatgattgagagtcaagatggagttttcgatctcggacattaacccgtgtcggcactgatattttctgcatacgcgatcttcctacacagcccacattccgttgttcctctaccctttcttgaacaccacaagcaaaactcgaccatttgagtatctccgtttgaccagtcttggtgtgattggagcacttgtcaaggtagtgcggcgaaagagttggagaatggtagctgaaagactcttagaggccactagttaacacgacagatctcccttctttttcttttgtatcttaccgacactggctagaacgataacactgaggtgattacgttcttgctctcgaccgagatcatcccgctgtgccttcgcatcatggagacgggaagcgagctctccaagaccgtaagtcgtcgtcatggcggaggtcctcccttgattggtgtcatatccttatggcgtcctgtattggagacattgacgtccctttttgcccacaatataggttgccatcttcattgtccagcgaattttgctggatgacatgggccttgcatatatctgtcaaacttatgagcgcttctatgccgtgggtactgttctcagcaacatggttcatcagcttgttgacaccttggccgtgcgcttgttgaagcacgtcgtcaaatgctacctccgactttctgacaatccaaggtaaactcaccattcatcaaggaaaaaatgagcaagagatacgcgacgttggacatgatgggttcacattctcgcagatcatgcccgctaatttgcttatcgtgccaccaccctatagggcccgtgaggcattgcgacagtgcttgcctgagccgttgcgcgacgcgacgtttgcccaggtcctgaaggacgacatgacgaccaagagatgcctggcgcagctgatcatcaacctctctgacaacagcaacggggccgtgaactagagaatcgctatagtttttgtctgtgttgtgagacctggaaagttggctacacgataccctttttcgtctctctcctcctccctcccactgcgctcccttgatgctcttttttttttttttttttttttttgccttttccttcttattctccatcttgtaatattcgcggtggcacatgcagcacttgtacaaattgtaattcgtttttttctattatcattattctttttttctcatagtgccgctgttgtccgggtagagtttatcctttccttctttcctcttttttttcccctcctcttcttcttcatcctctttgctttgacttgtataaaaactacgcgaagcggatgcatatatcacacagacttggtaaaatacatttttcaaaaaaaaaaaaatgcggttgtggacttgtgaatggatctgtcgtttgaaattgtgttcaaagttgggtactttttcaatctatcgcccccactatctttctcatcttcactctccctttctgttctcgtcttgtctctatacatccttcctttttggctttgtttttttatcgcgcagtccacaaggcggtagggacttcatgcggccgagtcgtcacctcggtctggatcatgcgatggatcgcgcacaaataatccacatacgacatggcatcgttgttcttgtcctcgaccagcaaattggagaactcgagttccacctggtccttgccctggcggacgataatcaagttcaagtacttggatctctggttctgcatatactcggcaatcgtacgcaactggttgctcgtttggctgttcagttcaggcagctgtcgctaaaatggatcaacgtacacatacacaaatgaagcgttaatagaatgaaacaatgagagaacgaaagaagaaaaccttctggtttgctcaaacaaaaacaaactgccggcgtggggaaataaaatctcctctccgccgcctcccccctccccagtgggggtttcttttccttaccatgttaggatcaacctcgtccaacgtcgaaacaccaaagacatcctgcaaaaagccggaggaaatctcgcgaccaatccagaggtacaggccttggccattctcgagcaagtaagcacctccggggttcagtcgagggtaagacacacggaccagaggtgggagcaagacgcggcctcttgcatccagcacaccaagctaaaacgatacagggtatggaggtgagctatgcgattcttataacttgagctcaacaacaagaaaaagtgcagcattttcaacgggcactgctcgacattttaccttttcgtccatggtgtgaactggaaccaggcggggatagaaaaacgcgatcgattcgctgacgcccatgcctttgagcatgcgcatttggtgcacacgcgtatcactgttgatatcctttccaccacggagggacttggacttcaacaacgtaagcgcgtagagcgggaaaagcttgaaggattccggaaggatgagctggtcacaaaaaaaaaaggttcgtaaaccaacaaagaggccgggacgatcaataacttgttggcaaaaaggggtggggggactcgaacgagatcacactaaacgaggcctgcagaagcctccttacctgtccgggagctgtagaagaggcacagttcttgcggtatgatgacaagatcttgacacacttgtccgtcaatgcgtcgcgtacctcgttcaagggtttgctcagtgcttgcgaaatagctaatacaaatagaaaaaacagacaaaagagctcatcagcatggctatcaaaagggcctttccttacttcccttgatttctcaatatcatgacaatctcttttttttctttacctcctttgctcaaaaagttgatggtcgtatccatgtccgcccagcggaacacgttgcccagcagcgtcgtcacaggcgtgctaaagttgtgcactcggacgcgtctcaggccatccgcagtcgtatacagcagtgcgacctggaacgatgcctccgacctctcatccagcttgccatcatgcttgaccaaaactccaaaagccttctccgagtcgacaccagcgagctccagatcggtgctgttcttcatgtggaagttgccaaagtgttccgtgattctcagaccggccgagcaacgcacacgcatcaacgcattgaagccgaagggtcgggccacaatcttggcaatgttgcccacaaacttggccccgtcgcgtgcggcgttgaagttggggaacatgaaagtctcgccaccggtgatgctggacaggcagcccaaggtcgacacgtccacgtaggcattggggaacaggaagaggtcgatgcagagaccggcatcgacacaggtctctcccagctttttgtaaaaatcatcttgaggcgcgtaaagagttctttccttgtccgtgccatagagcttggaatcgtcgcggtgcttgagcgctccaggaccataggtcggaagggatgtctgaaagagaatcagctttcctccacgggcttccaaggccatgcataccgcctgaacaaccgctccaatcacaggctcagtaatcttgttgtctgcaaaaagctgaggaatcatctcgagtaacgactcgacaatggtcctaagcagtcgtcacaagaataacgttaaaatccaaacttctcacatccccgttaacaacagcgggaaggaagagaggaggagccgtaccttgaagtctcagggttcaccaagaatccctcactgagtgggacaaagacatccgagacatccgagacgaccatcatctgcgcctgctccaggttggcctaatattgattttcgggggatcagcacgcaatacaccgtgtcaatacaacgcgtacgagcgccaccatgctttgtccagagatgtcgcgtcgtcgtgttcgtcaagataacttacagagaggttgtaaaaatgaacattcttgtcgtaggtcagaattccaatctgggcacctggagccagtcttgaaacgccattggcatcccagatggcgtccctgattccagcgacactctgcgctagcatgccactctgaacagcgttccaggagacatcgataccaaagacatacgctgcaggggcgggggtcttgttccagtactctttagggacagcaaactcgatcgttccgtttcgcaactcgggtctctggtccaagtccagccggcgaccgttcatgtccaagttgcaaaagtagttgggctcaatctcgttctcaaacagacacatgttgcatacgaagcgctgaccgccgctcgtgaagatcatgtaggggttgatataggcgttgcatctacggcatctagcagggcccgattcaccaaaatctacagtctcgattggcgcctacaaacggaacaaaaaaacccgcccggcacggggtacgttagcaatcagaatggctggaccaacaacgcacgtttgcgattcagattgtgatcaggaattagggagagcgtacctcatctgcacgaagcttggccagtggctggataacgagacccaagggtaactgagaggtattgagcagttcttcggtgttgggaatattgtacgtggtcatcctgaagaagcgaggattacagtttccttcgtcgacagccataaagtctgagctggcgagaggcgtggcatgtactctggaagaggtcatgaatggcttgtcatcccactctgcctgatcagcttcctgaacagcgacaggcgatgggatctggtcgggatcaattctggactttgaaccgggctgagctggtgcgtgtgcaggtcctggttgaggcctgaactgttgctgttgctgctgctgttgctgtggagccataggttgttgattcataaccggctgctgctgctgctgctggtgcggctgctgttgctggtacggaggaatgggttgctgaggaaatccctgaacaggaggctgcgccagattctgagatccatagggttgcggctgcatgttgccagtggcattgtagttgttcattcctggctggggcatgggaggtgcgacaccgggctgtccttgcgccggtggtggtgctgaggggtccgcggcgaagacacgttttgctcttgctcctgcctttggcttgaactgctaaagtgataggtcttatgttaggcaatgcttcattctctctgcatgacattcatgccctgttatcaatgcgcggtcctgtacctcagcctgcgcagggggtccttgaggaggcagtgccgaaaatccaggggtctgttctgctacaccattggacccaacattcatgttggacatctggtcgtagagcccgttcataccagcaccgttctgatccgtgggtgcgggaggaggggtgagttgctgggtctgctgctgctggtaaggcgactgctgcagtggcggggtttgtccaaggggagttccagcgcgctgctgatgaggctgctgaggaggttgctgaaggtgactaggcgattgagcgtactgtccagccgatccaggagtgcccataggcgtaggcgtttgattagaaaatgttggacgaggggagggtgcatgcgagggcggtccggcggcttgacttcccggcaaaggtgatgcggtcctgatgggttggttgccggcaacaggcgggcgtggtcccatgggaggtcgtgctcctgatggcgatccggggttgggtcgaaggcccggctgttgctgctgctgtgaatatggctggttgccgttgacaggaggccttgcaggcaagccgtttcctaagcacagatacaggtgctgaatgggtcagacgtctgtcctcactttgaaacccgtggccaatgtgccagtgtgccgcgttatcgccaagaggactcacctggctgcatagggcgcacgcctgggggcgcgttgtttggtcgaacgccagggctgccctgcatagggggacctggacgcacgttcgcataaggacttgggggagccctctgctgctgttgctggaagccagctgggggctgctgctgtgggaagccgttgggcgcaggggagtactggccctgtccaggctgtccctggcctggccccgggtatacagagcgctgctgctgttggtgttgttgagggtacgctgacattgcttctcgccgaattcagcctaaggatgagcaagcggtggacagtgagaacgggggccgagaaccactgggcgcgaggactgttggagacaagggcagaatgtaaaaagatgatgttgatcttactcgttcctgaatggggttgtgtgctgtgcgctgctgttggccggtatcctccgtaaggctggctggaagtggaagcgctgcgcgagggagagcgggggtgatgtctgatgagggtggtgcggatggtgcggatgatgaggttgatgaggacagccaagagagatctgctcgtctacagggttaaaatgggtcgaagcacaagagcgaggaacggacgtggtgaggaacgactcgacgagagcctattggtggaaaattagagtgcagcgtgtccaagccacgggcgaacttctgaagacgtgcagggacgcggaaaggccattgcctggtgaatcaactcgagtcaacgacatcattgcacgcacactcagcaagacaccccagcctacttcaacgccgcaccatctgacagcactttacaggaaaccaaaaaaaacaagagcaaatcacagtacaggcgcagcacatcagctacaatgtaggctcctgcagacagccgacttgaacggacaaagatcattcgcttcacacaggggactaacaacgctggattcgacgcatttgctgacattagggcgaaaggaaaaccaatgagaggtcgctttgggcggaaaggaaaggtgcgtggaacttgactaaagcataggatcgagtgtttgatctgcgcacaaacagagcacaagtgcactggactaaggattgatctttctggccctgtataggatgatgacgaggatgagccaaccacaggaatatcgtcaatggcttcttcagtgacggcatctcctacgagttcaaacagtggcacggctgaccagttttctcaaggacaagcgagcgtcttgaacatggcacacatccacaagccattcaagaatccaaagtggcaggtgtccaaaaagacaaagaatttgaagcagattatcactatggagaaggccaaggagtacaagaccagcacaccgacctgtaagtacctgaacgcggatggggaccacacggagttttaagttggcgtccttctcacagcactttgtatatcaccctcgcaatcgtagactggaatatcgaagccttgccctccatgactcctcagaagaagtactgcgacatcactggattggaggtaagtttttttttctcctcaaaaaagagtgtttctgctcgttatgcttcacctgctggtcattcaacttggcactgcacactaattcacgcttgtctttctaggcgcgttatacggacccaaagacgcggttgcgctatcactctacggaggtgtaccagttgatcaagaaccagcccatcggtgttgtgcagcagtatcttggtctccgcaatgcagcagtcgttctcaagtgagccacgctcgactgtttcatagcctgtacaatatcattttttttgttttcggagtgctactcctgtttgcaattgagtgctttctgagtggtgtccgcaggtgtttttctggatgtgcggatgcgtggatgcgcggtgcagggcgacgagtgttctacgccctgcagcacacggccatgtcgtcgatgtgtcctcactgagtcctcgatccgcctacgccgagagccaaaaaaagcaccaaatcttaaaaaatgccaagacacgacaaatcacagcctgtgcactctttacccttcgtttgccctctctttctctcactcacgttctctcacacgcctctcactctcattctcgcactcccttacatacagattccgtctttccccccacagcattgcatccgctcctcagcagcggtggtccaatacaaagcgaacattccctggtcgaccgttgcctcgttcaatgtcaaacttcgattccacagacccctttgacaatggccacccctggcaagacgtgccatccaaccccgccaggcccaggagtagcaacaacaacaacaacaccaccaacccagcaactagaagctcctcagccgccgcagccgacagccgggacctgacaagtccccatataccctccacagaagcagcagcagcagcagcagcatcggcgacagtcactgctccgtcgcccccaggaccacacgcccgtgcagagccagcaatttcctctacaccatattcttcaacatcatcagctactgcacctcccaagcaaaagcagactctgcctgcagcgtacgaggatgaaccgccgtcgtatgaggccgcaatcgttcgcgatattcctcagatccacgacaactacgaccatttgagggggcctccgggtcaacgtggggtcgatatcaagacaaggatacctctcgaatctaccccctcgagcgactatcgaccctcgtctgctggcccgagtggtagcgcagcaggtggcagcagcagccacagcagcaccagtagaaatgacgcaaatcacacttatggtgctattcagcagcaacgcccttcctttgccaacattgctcagccatctgcaccgaccttgctgcagggccagacgtctgagggacgcgctgacgaggaggcccatgcgcgagatgtagatcgattgctcggcccctccaaccactcgcctcacccacatcctcaccatggccatggccatggccacgacccctctgatacggacgacgaggagccagattcacattgggcggtcgtgggggacgggaaggcatggatagcactggcgtacattctgttggtgttgctaccatgggcgctcttttgttttatctggacactggcgaccttgatcgtcgcggctgttagcatgattatcccaccgttgggttatctgatcgtcattcctgttgtcacctcttggagagcccttgcaagggtcgacttggtcgtatcccgggcgctggtcgcgcggcatgtgcgcgagagatatcaacacgcggcagcgccagtctttgtaatgccaccggaacccgtgtctgcctcctcctcctcctggaacacgcattcgacgcgccacaggagaaggagacagaccaaaaacttgtggcatcgtggcgcgaagcatctcaaggcgaccatcaacaacaagcacactgtcaaaagcatgttctatctcatgatctggaagttgttctatgcgctgcccatctttctggtcatcatcgtcttctcggtcctaaccgtcccgttcatgatctgcctgctccccacccttttgatcctgagtcgagcgctcatcaactggcagtttcggtgggcggtcgtgtggttgactgagaagcctcagccgatagccttaccatgagatgagagatagaaagggggagttctgccagaataagaaacagaaaaatacacaatgcatcattcaccacgtcttcaagtaacctttttttttttttttttttttcctttttgcctttttatttcctttttctcaatcgtctttttgtaggctggtgagttgcagatgggatagcaaaggcatgtcctgagccaccacgcgcaccagatggaggtcgagcacgctcagtcgcaggtcaagcctctcaagccgcttcatgttctcgatcgccaacagcagacccccggtactgatccctaccacctgatccagttgcagctctctcatccgtggacatcgatccgcaacacgccgcagggccacatccggtagtggccaggcacccaccaaattcaagcactgtaactgacgcagggttgaaagcatgtgcatctctttggatcgtatgtacagtagtaaattcgatcccggatcctgcggcgtcgcccatttcacagacgttaatgatggctgttgctgttgctgttgctgttgttgttgctgttgttgttgtgatggaggttgctgttgtctcgacgcccattcctgccccgcagtcgtgaccaacgacagctcctcaagcgcagggcatcttgccaatgaatccagacagaaatacagactgatctctccctcgagcctgagtcgcgtcagctgcggtatatcggaggtgaaatcgagcgaggacggttgccagagaggcaatcgtgaatacgccacgagttcctggagggtgtcctggaacgcaaacgccgcttcttgaacacagtccatgagctcgagcgtgggtccttggagatgaatccgtttcatgcgcggcaacttcttggctttggaactggcgaggattggggtgcagatcaaggcggattttttctcctgagcagcccaatgaaagacatcggctctccgaatcgggatatggatttgttcgagcgcgcgacaccgctccaggtactcggacagttgcgctgctttgctctcggcgggttcggacggggggaatgtgaacgacaaccacagcttcttgagccgtgggtgcgcgatccggtcaaggtagagcaggccctgcgcccattccgtagcatcaatctcctcaacgtccttgaaggcctccaccatcgtcaggatgctcctattgagcgttgggcgcttcgtgagcgagctcgtaaacattctggacgtcggtgataatggctcagcaaacacctcggttgacagcaactgttcgtctgcttttgtgattgttatggctgttgttgtgggtggtgttattgctgtggttgttgtcgatagagtagctgcatcgggtgatgttgatgctgtttgcgaacccctggcaactaggatattttccttgagaaccggaccgaagagcattcgatgcgagattatgaaatccaccacgatctctgcgcctagcatgttctgatgctcaaaatccgtcagctcgagccgggtcagcatcgccatttgggggactagactcaatgcatcctgaagcgagggcgcgtccagcagtgatagagacagcgtttgtatccgagccgcattatgagagacaaattctctttggatccggtgcagcacatcgagtgtcttcttgttctccggtggtattggtgagcctcctccaccgccgttggcgaccagtccttgcaaagtgatcttttttggcttgtcggtcggactctgagccaagtctgcaaagagcaggtggaagcactggatcataatctcactcccttgttgctggtcaacatagtactgcagatagtcgatcttgcaaggagggcggacccattgctggccatatcctgggtactgcagcgcgggcagacgcacctggacgggcgtgcaggcgatcaagagctggaggagtcgggccatctttttcaacttgaagagttctcggcactcgagaatctccatgcctcccttgcagctgtgttgctcctgggatggattgtggcgataggagtagaagcgcgtccggcgagggggctgtttcgggctgctgctgtgatgcgtgggtttgcttgtcgtaggcactgtaggactggtcgtgcggacagaggagagtgttgttgaggaaggattaagggacctggacgcgttggtgctgtcgctccaactgtccttgttgtcctgaccaccccagggaccggccgtggccatcgtccggcgctggctgtagtcatgagcgaggagggcccggaagggtgagcggtagagaactggcgcgacagtgtggaagagggcgtggcaggtcaagaggagactgtgctggtccgggaggtccaggtagcggaggatatggtggatacattgtgctggcgcctgtgagatgtgcattcgagcttgaggatcgacgcggcaaaggggatggcgacggaatgagcaaaggggaatgaggcggctgcaggcgaggtagagaatgagtctgcttggggtcgatcctcagagagcgaatgtggagacggcggcgacgcggcccagcgaacaggcgggagcggcagagcagggtcgacgggcgaggccagcgggggcgaggcgagacagggcgagagtgtgagtgtgagtgtgagtgtgagacgaagagcgacaaagagcgaagagcgagagagagtcgagggacgaaagaaggatgcgcaggaaaaagagaacaacaaccacagcacttcaggcacttcaggaacgggtaaacgaaaaccatccaccaccaccaacaacaacagacatacatccaccgacgtactctaaacgtctgttcgacgcggtagatgagttgcggcccagccagagcacggccagaaaagcgtctgcctggcttgtctcccccccggctgcaccatgcgacgtgcaagcacactgcagcacatccgagctgacagcccactgcgcttgcacccatccatcgacacacacacactcgcacacactcgcacacactcgcaccacaacacatcgcattcgctcccgcacccccctccgaaaaaagcgtcatctccctcggtccagccgtgctcatccttgggcagccgccctcaacagcgacctgattgcgcgtgctcatgcgcaacgacccttggctcatgtttaggctatcctgtcccatcctctctctcgcgctctctttctcctttccctccctctcacttcactctgcccaaaactccggccaggcagcacccctgactctctccttccccttccccttaccagcaaaccgagcgcctttttctcaaccccatctcattttttttattttttgcgatagcacaagtctcacaacttcatatttcatatcattgctacgctactttagaaggctgtgtcttccttgcaaagaatgaactggacacaaaggggagggggggcggaaaaaaaagaggtaggggaaaaggagagggagagagggagaagcatccaggaagaattccaattgggaggacgactcgccactctgtcctcgttttttttaccattttgtaccttcatggatctttgaggtgcagtgcctctactccacatgcaattgcacgcattacccctgttttcccgtttcccaattggcgcgagtcttcatttccagataaaaaaaattgaacttcattatcttgacagcgtcccgttgactactgcctccaaagtgtcctcagaattttggctggggttggctattgagggcaaagctggcacatcgtgggaagtgccatgggcaaaaacagcgagagtataaagtgcaagtgtatcctataatgttgggatgatgtattcacacttgaccaatgttcgccatcaccctcccgaatcgtagacagagatgcgatttcagtaaagcagcacagcaaacttcttggaaacacaatggagataaaaaaaaatatgaataaaggataagcttcctcgttcttagctaatgctcttgcttatgctactgcggctgctattgctcatgctcgtgcccgctatcaaaggacttggtagaccagtggtcaaatatcctccacaattctaatgggaggaagatcctcatagcagatgcggtagatcaccgtcatcaacggaaactcgtggcagagccccttcttggtcaaaatgttaaacatgtccttggctgtcgacgttccctgcagcttttgtccgttcaacatctccttctcaagctcgtcaaaggatttccccgtcgtgacatgggcctctgcgaccttgcggttgcgacctcccgcacaggtcgtaatcaagtccgcgactccgcacgactcgaaaaacgtctcatccttgacatccttgtaaaacatttgcgcaaacttgcgcatctcgtagagcccaatgcgaataatggccgctttcgtgttgtctccaagtctaaagggtgtcaaagtgcccagaaacaatcattagtgggggtaccatgggccgacgctttttttaccgacaaatagctgctgcgaaattgcgagtcaagaagaagcagaaaaaaacattacttgagaccatccaccagtcctccaccgatcgcaacaatgttcttgagtgctccacagagctccactccaacgacatcatccacaatattgaccctaaacttgggagtgtgaaaaatctgcttgaacagctcgccatcgcccaagttcctgtatccgatcgtcgtctcacagaatctctcctccgccacctcgctggcaatgttggctccgctgagaacacacgaccggatcccaagcgagtcctggatcatgtctgtgatcagtcgaaacccttggccactctcatgaacatccatgcctttaatgagcgagatggccttgcagttgggcgagatcctgcccttaagctgctcgcacacgcctgctacaaactttttttttccgcgttgaagagaggaggagtggtaaatgggagattagtcagttgtaatccaccaaacctcaccagtccgcgcacttcttctgtgtgtgtaattctcatagcataatgcatatgcacattcactaagcgccgagagttctgctctcgagtgcaaatcctcctagcagccaccggccgtcatcgcttcctgtggcatgtgcgtcctgtactcatgctcttggctggtccagcaaagtttgttcagtgtcccgtagttcaaagatagcgcccgctgcgcgttatgcgaaatcggagaggacaggtagcgctgcccaaaagaggaaagcggggcaaaaaccttatctgatgatcaagcacactcccccacactgtgagaaaaaaaaaaccaggaccttctctggcttaaggtgttgacccgtcggtccacgatttacctggtgagggaccacaaacaccagcatggtggcatcgtcgcaggtcttttttagttccgagcatgcaattacgttgtcgggaagtttgatgccaggcaagtatctaacaaagtaaggagagacaccacaatccttgatcagtttcgacgctcgagcacggtttccgccagcctcctatcaagcctcatgaccgggtaggggtgttatcgggaaggttgatcgtctagctgcatgctgcattgagtgcatacgggaaaggtgagactgtcgcgtttggcaatcacggtgttttgcgtcgacccgagatgctgcagccatgataaccccagcttcctgttccaaagcatatgacgacacgtaatcgctgatctgtccctgctggtcgacatgtaccgcccgaatcctcccagtcaaagcaagagtagatgcaggtgatggcagctgtataggttgcataagtggatccactttttatgattttttttgccccaaacaaaaaaaaaaatgctcaagagtgttttatgcttaaaaacagcaacaagagctttacagctctcttcggaagcaagaggagaaggaggagggaggaacgccgtgtagcgaaatagatatcagcaagaaaacgacaagagaggacacttacttgacattctcatgcttggtgttgataatgtctgtcaaattctggccgtcgacctgctcctcaaagacccacatcttgacctccttattgaaatggggaaagttctggacattgcggcctacaatctttgccacggccgatcccctacagcattataaacgagaaaggccaacgagcaaaactgaatgatgaatacatgggctcacttaagcatccacgcggctctggcgggcgcatgaccagcgtgggagaataacgcgctcgcgtgttcgcatcagcctttccatcccgcatcccccgtgtcgatagaatgctcttcagaccaaatggcaaatctctgcattaccagttgcctgatccgatgattgctactttttccgacatttgttgtgcgttgttgtgtgtcgtcgcgttgtgatagagagcgtgttgctgctgctgctgtcgtgtgtggagcgtaaagtgcaggatgtcctcgcgtggtgggctgctgcagaaagacgtggggtatgggccacggtaggggtgagaagagagaggaggagggctgtttgtgcgtgagcgaagtggagtggagtggagtgagaagaagagaaggaagatttcaagatcaaaaaaaagttctctgcgtcgtcatattgaggtttgaatgtcttgcctcaatcacggcaacgcctggtctcggacgaacctctgtccaccctcaagagcaagccctgtcgcatagaaaccgcttgggccaagtcttcgccagcggggctgttcttggcgagactgaccttgagagacttttgagcgattaagacgcgacgctgatgaacagcgtatcccttgttctggtacgagtggcacaccgcagggctgcacagacagcacggattgagaggatcgatgaccgacgtcgcacataatatccctttgcctgctgctctgtcccgcttcgagagcagtgaaagacatcgatggggggagggtgcggatgtgacgccgtggttcgaaagggtgagtcagcagctgtgttctgcatacacaaaaaccactcagtcgagcggaaaccgctagagtcagtagcctagcagacgcgccttgaagtcggagggacgccgcgcaagccctggaaagtccatagccagaaacagagttcatccttgcaagcgaatctctggtaggatgttgccaatggagaaaagccgaggcgacatatgctgtgttcattcctgatctttttgctgaatcccctcacgtcgcagtcactgaaggccgaggggtgagcagtagaagtgcatactacgagaaaaaagcggtctctcttgaaggcgccgcgcgtccggctatatacacctccggaatgtcgcacagaccaaacgcgtgtggcctcggcgcctctgcccgttatttacagaacccctcccgcggctagtgtgagcaggcaggtaccattttcatatgaaaagcacaataagcacatcccacattcatatacagcagccagaccaatctacttccacgctaagcaacccaaagtgaacttgcaagttggcgcatcgcaccttgttcacccacaagcacaaagtatacagagaaatctttcttaggatgctgacctgcatgctgttgaattttcatgagactgatggctggcatccgtatggtgcaggagtagtaagtggcagcttatgtgacatgcgccggtcttgacacctgcagaaggtcaagtgtacccgcctcgggagcgtccaagcaggtgcaacattattaaaatgcgactggtgtcaccttacactggtgcaatgtttctataggacttggtaagaagggagtgtaacagagtcccatgcatgaagcgcggagatggttgccggattgtgaaagcggtatgtgagagcatattgagcacagaaagaacttggagccccaacgaaaacgcgcgcactaaacgcgtgaagggcagtacaagaatcgcaaggtgatgagcattatggcatgataggatcccaggaacacatgccaagcgagaaagtgttcttatttgcatatttcgctgtagggacatggccttaacttttgttggagccatggtctgcttgccatacattaggacggtgtcgttaggtgaaaatgttcaggtcgccatggttaacatcacgggcatcatgatctagtgcattgctgtcggtctggcgcacttttcttttcttttgccgctttacatcactgtctgttcattcgcatgcgggagtcacttcgtgccagaccatgggggcaggatatacacttgtattttactgataaaaaacatcggcgcacctcgcttccagcagtgttcagaagccatgtacatctcgctcgatattagtttatttgacctccattcttaacaggtctgacatactctccgccactatcaaacagggcggccgacatttagagggaactggcctggaatattgccaggaggattgtagcgacaaacaatatattttgtggcttgaggtgagaccgtcccagcatggcaatctacaatggcacaggcaacttgagttgtacgcttccagacgacttgtgtgaatgaacctattgtaaagggtataagcggtacacccgatagaaggtattgtcagtgtccgttaataaactctatcagaatatgttgtgaataatataccagttcgcatccttaccagtggcgggagagaattgaggctgattgtaattatatttggaggactcatccatccaagctttaacagcgttcgctataccagtattggggtcggagctggcataaaggttctcaccatactagttgtatatgtacatgcatattttcaaagtgtttttagttttgatattctttttcacaatattgaacaagaacctcaacgcctaacgaaaactacttacctgccacttagcatcgctatgtgcatacctgcacatctgagcgtactgcatagtgccaggatacaaaagcggattccactgcaggggtctggcggcatacctagcgcgggccctgttatgttcagtgagaacttgatccgaccaggcatcggcagcaacagttggggtatgagcagcaagtagtgacacgctggcaaggacgaacgatgcgataataagcatttttggtgttcttggtttgtgttgatgtgcaggaagtggatgtaaaataaagatagtagggaaatagccggaaagagagaatgatcaacctgatcttctataagagaacttttgatatgaagaatcaatgacatcaagggacacaacaagggagaacaccaagggacagcatcaaggggcaacgctaagggacagcatcaagggacaacaccaatggacaacacctatgggtggcatcaggggataacactaatgggcgacgtcaaggtcaagaaacccagaaatagatatcaggggaaggacagagagaaagatgttagggaaggactgtaaaaaaagtaccaagaccaaagaaaaggtgcacactgtatctgttcaaaagtggtctcatgatgaggtttataccccgaacgagggcttcatggagatgccattctaacacgcgtagcattcacattgcggtggcgtgaaatgtttcctttatcttttcttttgaaaaggactccaggctatgacatctgtcacgcaacctagaaacccaaagacgtttgtttgagtagggtcagcatagggcaacgggcgatgacgaggattggttggctactgaagcaacctatcatgtcacttctccttgacgtccttcacaagggaaagtcggaagccgtgcgacgtatcgagagatgggcgggaacgtggatgcaggaccctttgcccaaatatgtgtgatcgatcgcatttgtcaaatcacacgtgaaaggaaacgctgcttgcattttaaagggccgtatagaataacatgatctgagcgtgaaataaaaaaaagcgaaggccgattgtacactcacgacatcgtgcaggtccttgccaccccccatcgtcgtgtgaacgtgaaagtccataaggtctactaccgtgaacgtgcctgaagaatgagacgtggccagaaagcacctccaaatcaaacctcctgatacttcaaggggtcatcgatttgggccgaaggaactcatatgattgcacgctgaatgaccttctggcttcgctcgatgctcgtttgctaagcaaagaattcagccgcctcgcacaaaaacgatctggtggagtgctgctgaaaggaacgagcttatgaaatgtaggaggattgttagcagttgaggggaatactgccattgataagggagacgcatgggtacaaacctaccagtgccttatattatggtcgatccgctgcaatcgtctttaaggcgaagggcgacttgccataagtagcctcttgcatgttgtacatgtactcgcaacgaggaaggtcagaaggcgacaagcacaggaacacagacacgtcgagaaggctgctcgcatcaggcttatcaaccgttcagttgaaagagaaaggagtattgaacagcataatcacagttcctgcagcaccgcttatccagcgagcgcagtatttaaggtgcgagatcgattcattcaccgcgtccatccgaggcctagtttccgctgtggccattcttcgcaccaagatacatgtacaatactttctgtctactgagtttgtatgagttctttcaagaagtcttgcacatggaaaacaaacatcgtttcaataggagcaccccaattctgctcaatcggcctttcaaataccgactcactctgcctctagccaaggacaatcgaaacgcatgcttccgcctgttcatcctgcctcatgtttgcctctgtcacgctcctgtctcgagctgctactgctgctgctgcattggctttgggtgaaagcgccgaattgtcgtacctgtctatgctccttggtcctgcaataaatagaggatagttcccctcctcgacgcttatctttcacctcattttcattgccaactcccactcttgcctgcacacctcactcctgcgaaagagacctgcccaactctcacttcagccttcgcatttcattcggcattctgttcactcatctcctccgtcctcattgcacctcataacctatacccactcaacaaagctcccacgttaggtatgtaaacacagctccaacctttatttatcccgagatattcgcagctgccccaacagaactggactcctttcacgcagcccactttccttgccgaccctctcagtccttcctcgggtctgaatataggacgtttggagcgaaaaagaacagtttgaaagttccgagagtgttgctccgtacacttttctttttttttcgctttttcctggccgataagcacattgttgtttgctccatagtaataccatacgcccactctcgccgccacccatcgtgcctcttggcttgatgaaccccttgacccaccgcactctcgctctcgaactctcgcaaacatacacaaaacagcaacggcgtccccttagaagcaggcgcaccgcacctcatcgccagtgtcacaacatccacttcatatcgatggcagcgctttgcgtgcatgctcccccccccccccccctttcagatgtcacaacaacctgcgccttgacctcctggcacattacgagatttcaaccccacccctttcttccctcctgagtctttgttgcgcacacttttgctagcagtttgcgctcagtcttggtttctaacccttgttctcgcccctctgtcctttcagtccacatcaacctttatatccataatgaccacgccctacagctcatctgaatccgacaactctgacgttgaaggccgcaaccactctcgcacctcgacgtcctcggttgaggaggagatcatcaagggaaccaacggcaacgccatcaagaaaaccatcaccaccactaccaccatcaagcgcacagcctcctccaactcggaaagctcagaaaaagaagagaaggaggcagtggcctctgctggctttattgctcgcgtgagctccctccctttggtccacgacagcgtctcgacattgcactcgtacgccaaggataacaagtacagccgttacgctcttgacactgctggttctgcggttgagactgtctccaagtacacggagccttaccagacccgcctgcagccccatatctccaaggtcgaccagattgccacaaagtccctggacctgttcgagaccaccttccccattgtcaccaagcccacgtccgagatcgtgacacaggtgaagaagcccatcgtctacgttgaggagtcgtccaagaacgcttatacccagatccagtcgacgattgatgcccgtgtcactgtccccgtcaagactgtgacctcaaacattgcctccactgcatcctccactgccaacagcatcgccacgactgcggcctcgacgcgcgatcagatcactactgtcgccacgtcgaccgccaccaacattgctgcccaggtcaacacccgcgccacgcctctagttgatggcctcgagaccatcgtcaaccgctacttgcccgacgaggaactcgagcgcgagcagagcaccgccgctcagagcaaccaggcctcccgcgtggtcgaccttggacgtcacgtctccctgcgcgtctctcgccgcgtgagcgtcggtgttgcacccatcacccagtcggcccaggatttctgcaagtctgctgagaacaatgccacattgatcaagtccaaggagtcgatccaggctctcaacgtgcgcctgaacgctttggtcgaggccctgcgcgtccacgccaaggagctgcaggagaatgtgcagaaggttcctggtgaggctactctgcgtgtgcagaccctgagctccaaccttttggttgagatcgactctctgtctgtgtacttgaaggagaacggtcccaagttccccgagtatgtccagctccgtcttgagcccttggtcggctttgtcaacgaccgctatgtgaccgtgaagggtgagatggccaagcctgatgtctctgcgatccagaaggctcgcaacatcctgcacttgaccactgaggagaccttgcccatcctccagagcgcagctcaggaggtcaaggagactttggtccagtaccaggtgtcgatccaggagaatgtccaccgcggactgaacaaggtccaggaggtgaactcttctgtcagcgatgctgccgctcgtgctgtccagagcgctcgcgtgaccttggtcggcgcttagatacagcaccgagaaaagaacaagaaaaagaaaaaaagttgacgcgatcgcgccactttgtcatgaacaagttatgaaccaaaaaaataaaagaaaaatacagtcaaacctccgtttttgaacccctaaaatgaataactcccctttctgcatacaaaagtgcggacccagttcgctctaaacccctatggagccacttcagaaatgaatgttctctcatattgcataaatttgggtggtcccacggctatgcaaaaacagaggtttgactgtaagcatattttcactgcggctcgaaaaaaagatgacgtcattgggcgttcgaggcgaactggacgagaccccttgaactcaaggagagccctttccagctttgccgtgaacgacatcagcatctttcctcagttacaccccgctcatcattccacattccctcaacgcttctcccctccttctgttcgggttgagttgaaggtaaaactcgcatgcattccatcctcttcagagccctgtcgcgcgtcgttttcatttggagccagccggggctgaaacggatgggtagtaccgttgtacaaatgggcaagacaaagccattgcgtatcacggagcagctaatcaacggatgggaagaaagatggcttctgacggagagatacgagctgtcggacattgtgtgctacatttcacttccgcgtttcaagtcttggcatccgagccgaggaaacacacgccctactatctggtctaccactggtgtaccgtggacagcgagtgttcttcgcggaaacctcggacctcagagagagcatgctttcgctttcttttatttttgaagttgaggatcttccgggacaatatgcgcacaacacatggcgcgtaattttgcgcgttcatcagaccttcccaactttactggtttttttcacgagccaatattctggcacctgcagagacttggttcccaacacattcctaagtgacattgtgtcttttcttctgatctagaagttattgccaatcatcatcatcatcaccactgcccaataatcagtcatggtcgatccccgcccaaccatcaagaatgcggacatgcccgaagaggtgcagcaggaggctgtcgagtgcgctgttcgcgcatttgagaagtactcgatcgagaaggacatagccgcgttcatcaagaaggagtttgacaagaagtacggcgttacatggcattgcatcgtcggacgtaactttggaagctatgtcacccacggtatgtctcttggtcatactttaggctctagtgccttatcgcagtgagattgtatggcttgagatattgatatttcacgatcatcatttgtcacagaaaccaagcactttatctacttttatctggatcagatcgccattctgcttttcaagagcggataagggggaaaggcatgatgttctgaatctaacctccgtgccttgttttttcttggtcgtcctcaagacaaaaaactcgcgctttcttactccttgagtcttaatcattacccaaataatttgcagcaaatatatcgatgctcaagcgttctctgtatctcaagaaggagtgcattctgcgaaattggtacgcttttggaaggaattttgatttcaggagttgtggtgatattcctcagtgttctctcatgcgtaaaaggcggggtggcctgtgcgctttggaggatacactgtatagggacaatgcgaggtcgattcaaatggagaggatactgcttctgacagcatcgatgcacacccaacccggaagtaacagcgaacgagacgagggcaaaaagcgctgccttgagctaacgtgcggtacgagcgcacaagcagttgcaaggccgccgagggagcgacccttaagtgccaatttttttcctgcctcgatatcagcgcacatgcgctggagagcagtcgttccttcttttgatttcacactatgggtgagtctcatacgccgctatgaggctgaagaacggattcaggatcatccatccatgccatccacacgcaccacccagccatccatctatcgacagcatacacgccagcagacatgcagcagaaatattaggagcgttgccaggagtaccatccttgaggctctttcaggatgaaaaaatcttcatcgggagcactcaatccgacattaagcatgcgcccttctgcttgaacagggactccaatccgacgacccacctttttcccagtcggcaatctcgatccagcaacacaaggcggggaaacctatgcataagcgctactcggctgtcgttttcctggactggataaatctgcagctgggcttcctttggctgtcagtctgcgatcaattcatctcccaagtgggacggttgacgcaggcttgacaaagtcttgggacctcttggcaaggtgttcagcagagcaaggaaagctcttgtctgtcacaacacagcagctactccttgtcgaaggcaaaaggcagatcatcggacaacttctgctcaaggatcaaggagacatggatgaccgtcttgttcagcgaggacgggacgatccgatcgaatggaatgggatcttctgctcgactgatggttgaatcctcagctcaaaacaacggacacggagcaaccagcaaacagcaaacatgacggccaaaaaaatatatacatatgcacacaaatactgactttatcgttgcctttctctctctctctcaggtatcagcagagactcccgccacaagcgctccgcttctggagccaagcgcgcccaatatcgcaagaagagaaagttcgagttgggccgtcaggctgccaacaccaagctcggtgctaagcgcatccacgaggtccgcacccgtggaggtaaccgcaagttccgtgccatgcgtttggatgctggaaacttctcctggggttccgaggccatctcccgcaagacccgtatcgttgctgttgtctacaacgcctccaacaacgagttggtccgtaccggtaccttggtcaagaacgccatcgtccagatcgatgccacccccttccgccagtggtacgaggctcactacgccacccccattggtgctcgcaagggcaagggtgctgtcaaggtacgaaatcatgacactttgatatcatcagcgggttgtgtagacaatggatcagacagcacaaaagattgcatagatgagtgtggccttgtgcagaggtctcatagcttgaacctgtggagagctgcgcaatgggaaagctagaaggagatatcaaggagaatgggtgcacggatcagggtcagttccaatggtgtggcagagccctaaccatccgcgttcttttcgtttgctgatcaattagaccgagtccgaggagctcaacaaggcccgctcgaaccacgtccagcgcaagatcgagtcccgcaaggctgatgccaaggtcgaccccgcccttgaccaccagttcgctgctggccgtctctacgcctgcttgtcttcgcgccctggtcagtctggccgcgctgatggatacatccttgagggccaggagttggctttctacatccgcaagcttaagaagtaaactggctgtccgctcattttacaaataaagttgccaactacgaaaccaaagcatacacaaaaacgcttttttctgtcccaacgcgctgcagggatacatgtgtgtgttctgctgaagagggagaaatagcgggcagtttttgatccacttttttttggccaagtgagtgtagtgtataaaattcggcccgatttcctacatttcccattgttcttctcctctttcacccaattgattcattctgatggctgcccgtagtcccatcacctgccatgtcctggactcctcgcgtggcgtccccggacgcaatgtgcccgtttcactcgagaggctggacccagctgccagcaacacctggggcggccttgctcaagggtaaaaaataaaaaaaaaagatagcaggcggccgcactaaccaccgtcctgtttctcgacttgcactcacttgaacaataatgcaacgtctctttctcttgttctcccctggttgatctcgtagacaaaccgattctgatggacgcgtgagcacactcttggatccttcataccagctggttgcgggcgtttatcgcatgaccttccagacttcagaatactgggcttccgttggcgtcaccagttatttccatccttatgtccaggtaaagagcagttgagaaggcggaggggaggaggtgggaagccgacggtgtgtgggttcagacatgtcgcgtacattgcaattgagacaggagcggttccacctgtggttatcttctaacacttgcaacgcgttcttgacgtagatcattttcgagattgccgcgggcgcggagaagcagcattaccacatcccattgcttctgagtcccttctcgtacacgacctaccgcggatcgtagagaggatgactggtgtagcagtgctcagtactcagtgacaaatgaaaaaaaagacgcgatgtgaactcaaagggtaataaaccgaagtcgcatttattctgcaaggatcaagatcctattccaaactccacaggtatggttgtatggcttatcgtagaggggtctgggtctttgccgacgagtatgatagcatagctatgcgtcctcggtcggggcagcagcagcagcagcctccccagcgctttgttgacctgtagggagaggttagagcaacatcagtaagcgcgtaattttttttaaagaagtaacagaagtgcagatggtgaaagtgtcttacgttgccggacttgctcagcaagtgctcgtcgagcctgcattttttccttcagctcgtgttcgagatcgagtcttcgctgctccacggcgctcatcttttggtcgagctccaatttctgctgctcgtaatgtgccttttcagtgtctccgtcgcgaccttcacggatggacttgaccttggcgaggtgctcttccagcttttgcatcttttcttcttcaagggcctttcgtctggcatcggcctggtctagcctctccttgatctccttgatctcctcatcgcgtgccgagctacgggaaaggaaaagggacggaaagaggttgtgaacgaggcaaagaagaatagtaagaggttagacaatgatactgagcgtgacgaaaaggacgcatttgtttcatgatcctgaacggatgaatatagagacctggggtcctccttttgaagggcagcgatcttggcagaatgttcttccaacttggccagtcgaagacgttcctaggtgtgtaaaaaacggagaaagcgatgcaacgcacatgaggggagagaataacgctggtattcgaagctaaccatgatggattcaggagcactgaactgagctgtcattgggcgggggtttccatcccttgcggcacagtacagtagagagcgcttttgttccactacatcatctttaccctttcctccctcgtctttgtcattggtactcacctgctccagacgggctcgctctgcattgtcttgtttctctcgaagtcgctctttcgattcatcacggctgaggccagccacatgcctgctcttctcagacacttccttggcatgcttaacgtattcatgggccttttgtactttttcttcctccaatttctaattaagcaacaaatgagtaggtatgttttggatttgattacaaaaaagcacgtatgcggatgggtgtagggtttgaattcagtaataaagtgatgcttggtcggatctccatagaagaagtttttttttcagtgttgcgtttacctttcgacgttcttcggcctcggccagcttagcgtcgatgtcctgatgcgtcctggcgttcagttgagtagagccatgatgcaatttcacgagcccgtcagaaaaaaaaaaatgacaacagatatttttccttcctgtttctggacctacttgtcaggagaatcatgttgatgaagcctggccaagagatgtggaggcacgatgggcttggtgcccgagatatcgagctcagcaaggagagcatctacgcttgcggtgagctgcgggtcttttttcgagtccgacagggcagcaggttcagcagagacgtgggtggccattttttattttgtttctctcgaaaagattcagagtgggtgatcgagaagaaagagacgagaagcgtgagaaggaaggacgatgatgaatgttgaagggaaagcagcgagagagagagagaaggagagagaaaaaggaaaacgaaagaacagagagtgtttgagagagtgagaaagaaaggtcgaaatagggggcctgttgcgttggcgcacaacagcgcaaccacaacaggagggaaaagtggagccaaaaaaaaataattcatgcactgggcgcatgccactaaagaacttctgccctgtccctgtgcacgatccctccagtctcttgcagtgcaggtggatgcagggatgacctggggtacgcgtcaatgcatgctccggcttctggcggatgcactgtgtgaataccggatcgagaggcgtcatctggacggaagatactggtgtgagggcgccaggagttgatagaccttcttttgccaccaaacgcgccactggtggtggctttgcgcacacaccaacatcaaaaaaagcgagtcgcctgtgctcctttctcaactcctccactccaccatggacaacaaaggcaacaagcggcccatgccttcgggcggaggaaaggacaagaagagaggtagcgtgggcaggactgtgcgaatgaccctgctgctttccatggcgtttcatggttaaatgactgaatttctgtcattgtcgttcatgcgtccatgcttttgttgtcctcctggtgatcgctagccaagatgcagcaggcacgttctatcgacacccaaaagtctgcttcagcttcgccttcataccaatcgccagctggatcaggatcgcctgccatatctggtacttgaagttgcagcacgcctccaagtcgaccgtaggactgaggatcgactcgttgaatattgaccacggcgtatattgtatcggattaggcaacacaaggaacgagaggacgctggatattgtcaattttacagaggttagtgttgtgtcctttggctgagagtgcacggggactggacgtacaggcccgcattagaccaatgaccatttaactcacacggttttatcactaggcacgtgcattcgaaatcaacgcgatgcatacaggcatggagcgatccaaggacgcatccgccgagagagcattccagagtctgcctcgtaacctcagacgtcgagctgccagtcataatatcaaacgacttccagttcgactccgagaaagggctatgcgcgaggtatgatgtgtgatgaggagtatacgcttgggattgtgtaggtcgtttgggaggtctggaacctgaacttactcgtgaaaaaatcgttcctttctgtcatctctaggttgttgatactgatcaaaagaagggaaagaagccggacaacaggcacaagaagagacgacctggaactattgcacaggagtatcttcggaggcaaggaacaaagcggtggctagaaactcatatttggcatgccaagaggatgaagatggtcgagctctggggatacaagttggtaaggcaccggattttatattacttggctattgacgaaaaagagatcatactctcccttgggagaaagatgctcacacctccgtgtctaatcgtgtaggccgagcactcgaacgagcatggaatcaaatccgcgtacaaatccagtcaccatcagtgtattattcaggactcctcatacaatggctgcctggagatcacaggaactaaaagtgacatttcagaggtttttcggagcatgttggatcctacgatgcccactgttggaagcgctaggtaaagaaccccgtttgtggctcaacagttctgcgaaaagcattgtcgttccaaagttaacttgtcgttttgcacctcatgatggtagatatgtaacgggaaagagaaagtacacgacattcctctatgaatctgacgcatttcctcaaaagctgattgctcccgtggactttgtctggaggcaggatccaacaccagagatggcaatggatctcgacgagctctcgaagaacgaacagctctgggcatgggttcatccctcggcgctcgaattcgcaatgatcaaaattcaggaggccattttaaagaccaatatgaccgagcgcgttcatgtgaaggatttggaaaattcgttggtgatgtttgatttcacaggaccccgttctaccgcactgttgcaggccgtcctttctccttgcagatcggaggctggaaagccctacgaagtagcccacaaggttagcattgacaatgggaatattatgggacgccggcatggagtcaagtggcattatatttgtaatttggagggagacaaactaaccagttgcatatgtttgtccaggtgtgggaggtcgtctctaacctaagatcgtcatcttcgctccctccaggagccgtcctcagcttgcttgtggaagatcctcggctaaggtactagatgagccttgtgttttctcagctcatgacgcagggatctttagcgctcattcactcacagtttctctctgaattcttgtgcaacagtttccctcataaagcagaacccagaccagcatctatacccaatgagcaaaccagggcagctcaggaccttatcacgcactggcctaccacggtcgctacatctagtatttgggaaagtcaggagcgagaacggctactgagcactatgacaccagaatcaaaactgaacgaacgtcgcgcacaaaatctggtcccaggtacaaagttgattccttcacaggaagattctcggattccagtcatgctgatccaacgagaaggtcgacctcagattcagcgcgcacctggtggaggcagcagtgagtatgagtgtggatggactctcgttctgcccaaaggatgggccatgccgttctggaagagctttatctttgcaggtgcgaggccaggtggactgagggaacacaggagctttcactttgaaacccggcagtcgtgttttccatatgactttcccaacacggaggcgtacagggcgtatgtcggcgactaccgaaaggcggcgcaagccaagtacgagcgaaagccggtcgcgaagcggattaattattcgaaattgggtgtcgacgatccgtttggcccggcatggatcaaggtactggaagcagggattagtatgttgggaggggctgcagtggcggatttgagcgagagcagaatttggatcatgcagacacctaaactggtcacggcggttatggacgctgcacgggctgctggtgggtcgtcgactgagatggtatcgaggctgaccatcgagtgcttgaatttggcgatgttggactgtctgcaaggattgttgcggccgacgatcacgacacctcttgaagcacagcagcccggaccgcggatcgacgaggcgctgatcagggtgggcgtggatttcttgaacaggggaacaattggaatgaatggcatgatctatgccatcccagaggaccaatacaaggagtgggctgcacgtgtgcagttgaagggcaagaggactgtggaggggcgaccgcgcaaggagaagaaggaaaagtcttgggtcgactctgacagtgactctgacgagaaggaggaggagggcgaattcgatgatctggtaagtgcattcatgctttctcttttttttttatttggttgcgcccaaatcacacctgccatgaatatcgcgatgataactagatgatgtgggattgtttgttgggattttttaggagatgacgagacctccggcaggcacgcttcttggttatgtgacgacaggacagtactgctacagcgaaggcaagagttacgggatcggatgctgctccgcgacgggactggcgcgagtgatcgagtccgagaccaagcagcgcttggaagcaaccggcgccgggaaagcactcgccaaaactccacggatgatggtgctgatcaggagcattcgcagcaaggcgtctcggcttgcaaagctcactgtgttgtcataagaatggagataaataaaagcgaacgccgagtcttatcagtaaccgggtgttgacctctccctccccacaactcctttgaggttgtctagtgccctcttatttgatcggtcaggaacgaatgcggtcatgcatgacaggacagacagtgggactttccactgacgttatgttttatgtgctttttgctcctgtggttagtaatgtgcagatgcgcctcttgccttgagcagtgtcatcatgatatggactcggaaagacgagtagctttttctagggggagacatcgcatgaagtcatttttttcttcttcctctaagcgctcaaagccccgacagaatacaacacagcgttacaattgtggctggcaaccaaccggtcatgatttgatcatctaaatcatcaaggactttcaggagaggacaaatgaaagtgaattgacaagtcagacgtattatcgtcgcaagcaatttcctgagtcaaaaaaagaaaaaaacatcaagaaggcgaacccaaagttgggtgcgccctgcaagtcgtccacgctcgatatgtagctagatttttagaccgatttgaggaaattgccatttggtccgcgaagcctaaaactgtgcatttgcccaagttacacgcgtactaaaaccgatagtgtgccttcagatcatcagataccgcaagttcagtttctttttcttgtttattacaaaggaggagcgcaagtgctagacgaactacaagtacaaacaatgacatatttacaaaggagaaagcgcaattcaaaggtttacaatacagcccgaaaagagagaaagagaatgagagagagaaagagaatgagagagtgaaaaagaaaaggcacacgaggactagcgaagcgttgtggaaattcgacctagcgataaactcccatcgttcctctatcggtgatccatagccatgggaacatcgcgatagggttgatgacctcttgcctcgtattctcggcgggcgaaatcgggtccagttgcatgggttggcccataggcagccatttcagacttgatctgcggcgtggtcgatctgcgttcatcatgctccttcatctcaatgtctcggccctgagaccaaagctctccgaacgcctcaagcgccttgatctcgtcttcagagacatcgactccgggaccccctcgtcctccgttattgccaaggggatcatatggggtcgagtccacctgcatggagtgatgtacagccttggtagcttcctggatcggcgcattcaattccacaagtgacaatcgacgcgtcttgctggtggggtaaggctggggcgcatagtgctgaccgccagagaaatggtggatgctctgcgatcgaaggcgtccatgagaaatggacgggagtcgcggtggctggatctcgggcgaggttctcaaaggcggcagagtgcagctgtccatgcgggggtccaatgggtgcgcagggccatactctccgcttcttcggtgcggtggctgttgcgagacgtaataacctgcatcatccgagtcaaagtccgaattcgatgacagttcaggcgacatggggtgtcgggtacgcgagaaggagcgaagctcctggttcagcggatggcctgggttggcatacggagcgttcaggggaggaagctgctgatagtagccgctgtcggggcgcttctccgagtttgcaaagaaggcacgctggtctaatccgtaatccagactcggtcggtggtgcaacttggaggcgtaccaggactctgcaggtgggctgcccatggtcgacgactctagcgatcctcgacgacttctcgttgctccttggatctttttctggattcggccaccctcgcctcgaccaatggtcttggatgccctcgaacgttgctgcttctttggcgacaatggcgatgtggaagacgacgagggtgtcacaggcgaggggagcacaggagtggaggaccgatgctgcgcatcagacgcggcagtcatgttgagcatgggcatggactgcatgcggtcgcgtcgagccttctgcgtgacgttgggacccgaggcggaggagatagagcctcgcttggcagtgggggctttggggcccttgatgcttgatcgacgacccaccgttccaccgcccagaaggccggcctcactctttcggcgactctctgtggcaatcttggcggctatttccacagaagactcaccatcgggccctttggtgtgagtttgagtgtgctggaccatgttatcgaagcgactgaacatccttgtgcatccttcaacgacacactggaacggcttctcgcccgtatgttttctataggacgtgggagagtcaggtgtaaggaggaaagaggatttcagaatgttagagtattagtatattagaatatgtaaaggcgatatgatgccaggaacaggccccaaaccaaacaaggcgaggtaaagaaacaagcgcaatgaatgcgacacaaagaaaagaagaaagacgcacgggaggaatgaacataaacacgcgataccacaaactacaaaaaaagcagttgaaactctatttccgccttttttgaccggtgcatcaacagtcgcgcgggtccatttaaagtgtgtccaacgagcacatgggggcgagtggtccatgggcgggacagagaaggcccaagggcaagaaagtgcacagagcacgaacggggaaaaaaaagagggaaaggggaaagcgagaccaaccgctgcagggctgcacagagaaacaccaggcacatgtggccacgggcctagcagagaaaggcccattaagaacgccagccagggcacacccgccaatgtgcgtgcgatgacataatttccttggagcagctgtcatggacgattggcactgcgcgcataataggactatcctatcagaccccgctgtcatcatcatcatcatcctcatcatcatcatccacacgcaccctgtgctagtgaacctagtcaccaagagggcgcgggttgaagcgaacgactccacatggactactcaacccagcgggctctcgatggtgaccctccttccatgtagcacatggcgtatgaggtacgatggtcggtgtcgtcaaaatgatgatgcacccgccacttccccttgccatccctaacccctgggtgcaaaaaactgcaaagtggaaatattcaggcacaaaaaagaagttgaccgcttaccgagcgtggcgagcaaggtgctcactgcgagtaaacaccatgcggcaatcaccaaagccggtgcactggaagagtttacccttggtctgcttgtttgatccttggccctcgtcgttggcggcttctgcgtcgctaccgccatggttatggacgttgctgcggttactgttgtcgttgccgtgggtcgaggagggtgcggggctagtttgtttactgctctggctatcgtcttgatcttccaggtcgtcgttgttgttgtagttatagcgttgaaagttattgttgttattgttgacactactgctcgagtaaccttcatggccatagctgtatgggtggtcatggggttcgtgcgactgaaactcctgcagctgttgttgatgtggttgctgtggagcataaaactgggctccggcgtgggacccaccggggacaggataggaataatgcgcctcctggaaagtcatgttgccactggagcctggagcgagctggattgggactgagggcatagatagggcgggtgtagtctttgttggagggctgaagagggggacagcgagataaaaaaggcgaacaaaggtctgtcagtctgtcagtctgtcaggcggtggatggctgccacaggtgcaagtgtggagaggagggtggcgaggatggactgagggagatacaaaaggagcagagtgccagttatatgaagcagcgaaaaggaaaaaaagggcaggcggggagtacaaggaacaatcaaaagtccgtggaatgaacagcgagaaagagagcgaaaggggaaaaacgctgacgggtgtgcagtcgcacttatatttccaagacaggtaccgagcacagggacaggggacagagccaagagcgagacagggcacatgcaaaaaaaaagaagaaaaaaagacaagacaagacaagagtcaagatgctagcaaagtgcgctcaggagtgcggagcgcgaggcaatcgcagaaaaaaaaagaagagaatcgggcacgggtggacgagcgagcagaggaagaacagacaatggacaaagaggtcgagggggaaggggacacaggaaagggtacccgcgttggcagacagtcgtgcataagaactctaaaaacacacctcggactggtgcctgaatatgaaacaggctggaaaaataaaaagaagagaaaagaagtgtccgtccatgccagccgcacaaggcccaacaaagcccaaagccaagtccatgaaagacaaagtgcaaacaagattcagggatcagagaaaaggagcactgcacagaggtaacggatcaaagaaagatgcggccctgccttttctcgaatccgccctctctcggggtgctgccctgcccatttttacttctactctgccctggcccaggtcgcatttccaccacactggtctttcctcgttgatcccgtctgattgttttgttctcttcgatcagccatcaggcactggcgataaaaatgaattcggcggacgatgcgcaagccgacaagtgcaaaagggataaaggggtggtgaatgataaaacggtgcatcaggaagcaggtggcaagagacaaagaacgagggggatgaacagagggggacgctcaaagggcgactcatcccacagacctgagcgtgtttttttgaatgcaatcgaggagtagcataagcaacataggggtggaggaggaggaggagagaaaatgcccgaatgtagatacaggtgttgcgtaaaccaagaaggcactagggaactgaaaatgacaaaggaaaaaaaatgggtactgcgccgacttgacaaatcgtccataattgccggtttgcaggaacctgcatccagtttatgaagggttcagcctacaacccccaaaccttgtgaggatagggcaaaaaggcgaacaaagcaaaaaacgaaaaaaaggtgcgaaatgacaggtgttgcttgcattattcaaggttgcgtcttgtgtgttgagtgtgtttttttggttttggccaaagaggtgttgttttctttggcgtgtgcttcggctgggcggcacgtacttaccagaagtatgtaccaaggaaggtggccgtagcgatcaggctttttgagagcagcgagacaaacgatttcgggcaagcgatctctgcaaagcgcgggagtctactttgtcgtcttttcttgttctaggggtaaggaaatgcaggcgagagcaaagaaaagaaaacaaaaaaaaaaaggatgtagcacagaaccgcaagggggtcgtctgtaatgtgtatgctctttctgcggtaggaaaaaaaaaggcgccttggtgctctggggagggggcgagcgggagagcagatttaatacggaatgtgggaggaaggcgagtaggcacaggccaggggagagtgtgctgcagtgttgcggcaaggtgacgaatgtggggtagagacacgacagcagcaagggtgcagtctgggtggatgagaaaagaaggaaagccagaagggccagaagagtcagaagggaatagcgagggtgaaatgggcgagagtgaagacagagcgacaaaagaagagagaaaaaaaaataaacggaaaaagaactgcgagaacacctcagggccataagccgtcgtttgtggacacgctgacgcagaactagccagtgcgcaggccctggccctcagcctccagccacgccattggctgcgcggccatcctccaggtccgtcctctgcatatcgtaaaacctggcgagtcgcctgcccgatcctggcacccagcataggtcacaggaacagcaggctcttcgtcatcttgttcgatgacaatctgacagggagatttgtgagatacaggtgcgtttattgttcctgacatgtgcaaaaaatagtactaaaacaacagggcattcagaccacaagaacaaaagtgtataaaccgggcgatcgttgatctatctggtgaaaaggatcgcacgctgcaccgacacagcaaaagttaggaaccatcgacgacgcactgacggcctcaaacaatagacggcaaagcgaccgccgacaataacgaaggggaggagctcaggtcaagtgtaacgcgatcctcaactcaaacacaggtactttggcacttcggcacagagcatggtttgataaggactagcttttgttcatcatggctcagtgggaatgaaagcgggcagggcataaacgaaatcgcccattatagcttactgtgatgtttaggcttcaagccatggaagccgatgttgctgcaggtagccttcgctcatgaagtgtgcatataaaagaaggggaaatggatgcaagatgcatcgatctttgatctcacaacctatgtaaaaatgaaaacattttctgtatgactgtccttgggatgcacgatcgtgcaagagggggtctgttggtggagtgcggcaggcagggacagacagcaagagggcgacggatgaggtacggcccacttaaagctcgagagaccggcctctatgcagcgaggctttggcggttgcggcgcaatggcttgtggacggagcacctcagcgctccagtgcagcactgtatagcggctcgaaggacatccgtgcattgggcactgggcactggcctgcttttgagggtgtgcggagggctcgtgtgccaaggcacatgtcccacaaacccccttccctcatcgatgtcgctgtcctcgacctttttcgttcatccttcccagtctctccatctttcaccccttcaccactccatattaagcccccattcacacatttcacactctcgccatggacacactgacggtggaaatcagttcatctgaacacacaccacatcttttctccgtcacagtaggtcgacagtcaactgtgctgcacctgaaagagctgattcgacagcgcatagagtccacgtccgcagtctcttctggtttggagctttcctacaacagctataccctcgacaatactgacaccttggagcacttgtctggaaaggtatggcgcatcgtcgtggacagctgtatgcgcgtgtgtaacgaaaagaaatcccacgcgaccgacaaagtaactcaccgcacttcgtcagttcaactggggcgggacttcggactgcattagcctggtcgcgagctatgcagagcacagaggagagaggcaagacagcgagccctgttcacctgcacctctccgcttccgcacaggatcaggcgccagtataacatccccatcggcagcgccaggcgcaatgagcatttctgggacatactgtggtccacgtgccttctcacgctcaatggatggcttcagcgagaccaagactggagagcaggatcttatcgctgaggtgttctctcatgctgcgcctaatgcgacgtccatggcgccctaccagtacgctatcgtaaagtgagtacttgtgcgagcgtgatctttgcgccttaggcatcatacatgacgttagccctcgatgaccaggacttattcttgctgtctgctgcaaaacaattagcgggatgccctacttggttcccgcatcctacttaccccttatacaacttcagcagcagtcgctatatcgtcctctctgcacttctgaagctccatcccaacagtatccggtgaacagcggagaacgtgcgattctcgagcagcagcaccacaatctggaggcgccagcagcggatggcagggagcaggatcatgcgccgagagatcagcgcagagctgcggcgctctggctccttctgaagctggcctttggagtgtatgtgctaagtcagaacgggagcatcgaacgtatcgttctccttcacgttgctgcgttcataatttttctgtaagtgcggttagaacggctatgacgtttggacaatgaacaaaaaatcccatcttagcctatacaacgacttttgtttttgatatagtcatcaaacaggtcgtttacgaatagtacgcagggtagtcccccaaccgcaggagagacctgaagatccagcagcagatgccggtcatcaagcgccagcctctgcagattctcaaaatgacggaccatcgccacacgcacacgccacggacggttcaatctcgtcatcatcagcgccctcgggtagttcaaaggctgctgatagtaggcagaagatggctccgatgatgagcgggtgtaagagccagaggaatgaagaatccatgcccaacgaacgcaagggacttgccggttgtccactgtcagctgatcatcaagacttggcgcaaccaacggctgatgaatatgaccttcaggaacacgtacaggatgaggaacgagcccggacagaagaggaacaaccgccaaggctgtcgtcgtggtgccgcgttgagcacgcactgctgatgttcgtcacgtcgcttgttcctgcgcctcctccagaaatcgagcccgccctggccaatgccgcggcagcagcggacaaccgagctatgtagccgtgctatagctaaaactgattaacgttgccgtgtcaatttttatccacgttgcaaacaaagtgagctcatcatatgcctttcgcctttcgcccttcaactttgaaaggtgggctttggtgggttccaggcagtggtgagacaggtcggctttgctccagggagggcgagggggcacaggggctccaaataagaagcggcactctctttccactttgatgaaaaaaactcatccatccaccaactcctaccctgcatcagtcatcccatgcgtgcagtcaggtacaaactgttttgtcctggcgtggctatagccgtgatctgcatcactctgctatacaggcacatccgcccatctcggtactcattcccgccacgggtcaaatgtgtcctagtacccgacacaaccaccgcccacatcagcaatacccatttaaccgacccaaccgacccaaccgaccctcgcatcgacattgcctcgctgggacttggccccaacttggtctacatgttcttcatggatcgaagcaaccttgctttttacaggacgctcaaaatctgggacgatctggtcctcattgccgagcgacctgaacagtgcgaaggactggagctctgcctggctctgcaggaatcattcgtctacgagacactgcacgataaggtcttcaagacgctcatcttgctggaacagacgttcaaaggatggaacagcatctccaaactggacgacgacgtcttgatcgacattcgaaccctacgagcgatccaccccattcatcctttgtcctacgtgggcgattttgtcaccaattacggggatttgggattccccatcaagtatgcgacagggccttattataccatgggtcgaacggtcgtccagtgcgtgttggagcacaagtacgacttttacaacctcggatcgaacgccgaggatctggcggtgggctgggtcgtctccaagttctgcaaacatgaggcattcgagaccaaccgttacgatttgatctggcacaagaagtttagcggtctcaataaggtctgcattcttgatgccccggtatcgtagtattgaggcatttttctatccccccacccccctattacttaaaaaaaaaaggttgtactgtaccgaccgctgtagatcatcactccttgaattcgctgctagtctatgtattgaaaatattgtcaaggacaaaaagtcagcgggctgttgcattcttctgttgaaactctaaaacaacatacgtgaacaaggcagcaccgtctgcattgtaaatcaaatcgactgccccacttcttgttcacacaccatagtgtcacaacttgccacacagtgccacaacttgccattacagtgtcgtggcattcacaacatcttgagcaaaaataaagcattgaaacaactgctcgacaaatctttgagctcgcatggtacgtatagaggacaaagtcatgtaacaaaaaagagttttagaaatacatatactttctactgttcgtgcacttctttctgtgcttagttgaagacatcaccggcagcgacaccgaccaaatcagacttgaccatctcctcgaccaaggcatcaaactcgacctggcgcttccagccaagcttctcgttggccttagcggggttaccgagcaagagctcaacctcggtggggcggtagtaggcagggtcgacacggacgcggacgacgcccttctcatcgataccaacctcctcctcagcagatccctcccagcgaatggagctgccagtggctttgaacgacttctcaacaaactcacggacagtgtgcatctctcctgtggcgaggacaaagtcatcggcagtctcctgctggagcattctccacataccctcgacatagtcgcgggcgtgaccccaatcacgcttggcatccaagtttccgaggtagaggcactcctgcttgccaaggtgaatggcggcaacagcgcaggtgatcttgcgggtaacgaaagtgcggccacggcgaggcgactcgtggttgaacaagattccgttgcaggcgtacatgttgtaggcctcgcggtagttgatggtgatccagtaggcgtacatcttggcaacaccatagggcgagcgagggtagaagggggtggtttcgctctgagggatctcagcgacctttccgtacagctcggaggtggaagcctatagatcaaagaagcgggtgggtgtgaaaaaagaaggtttagcttgctgaggtccaaaaaaaaaatgaaatcaatccctgagataaaaaaagattcacgatatggctcgctcgctagcacttttctgtaacgatcgtgcgttgctgcatccttttttgtttccccctgttagttggtggtatttgacatggctccaccatctctggaacaaaacgtacctggtagaagcggacgaggtgagcaagaccacaggtgcggatggcatcgaggagacggagggttccgacagcatcaacgtcagcggtgtactcggacatgtcaaaggagaccttgacgtgggactgagcacccaagttgtagatctcggtggggaggaccttggaaatgatgtggacgaggcaggtggagtcggtcaagtcaccgtggtgaagacgcatcttggggtctattgtcgataaggtgaggtttgaaacaattgtagcacgtccgttaatgttgaggaaagtgggagcgagtggatgggagccatcgacgtgatcctatgttaatccagcatgacagaacgccttcttgcacaccgccctttgataaaaaaaaggacgttaagcgtgggctacttactctcgtgggcatccttgtagagatgctcgattctgccagtgttgaaggaggacgagcgacggatgatgccgtggacctggtaacccttctcgatcaaaagctcggcaaggtaggagccgtcctgaccagtgatacctattcagagcagcaaggcgatattagcgcaagacctttgtgtgtgatcagatgatgactcttcagaaggatgatggcacggatgatgatgatgagacgcaggtgggttgcagccgaggatgaggcgattctgtgggatgggcgcctacataccggtgatcagggcgaccttgcgcttgcggtagtcctcgggggacatgttgacgacttcaataggagatgacatggctggtgatgaagataagggaggagaggatgatggaggaatgcgatgggatctgcgtttgttatatcgtgatatcaagggcaggggtgcacgtttcgagctacagtgcccaaaatagcaactgttgccctgggacgagaaggaccccgttcggacaagccaccgcaacctccaactgattggatcgtccgcgtgcgtccgctggaccgttggaaattgggctgacagttgtgtagactgtagacacgcatcaagggggctgatcgacatacgcgggcgcacagcaacgcgcataaaccaaggtggcgcgaagttctgcatgcagttgtgtcttctatgggcgattgatagagtctctgcgttgtggccaatatgattgtcccttccctggaagtctgggccccgcagccagtgggctgaagctgcgtgcaaacgataatgtcgaaacaggccgatgcggcgtctcagcagcaccatagcatattcagagatggcgcgctatctacgcagcctaaatgtcactctagagtcatacagagcaggagacaagacacatccatggacgctttagctaatcgccggcgagcgtgaatatacatgcggtgtgcttgatgctggccatccctatcttcatgaagcttccgagcattgcaggatttgtgctcgacccccacctccgcccctcgcccttcgcgacgcccttcgcgccgcccttcggttaaattaaatgaggccgtcattttttaatagaaaaccgcgcccttgcccctcaagtcgtccgctgggctgtagtgttcttcctcgcaaaaaaagctgagtgtgttccacaggaatgtgattcgtggactgagcacggtttggagtaccgaaaacgctcttgtcgtcgactcttcctactcttctgctgctgccgtctccagctgcccatgctgcaccttcgttctgttccattctgttcactgccgtctctgcatcccacacacattcggcgactcaccaccaagcaggattcccttgacttcagacgtaatgttcttgtcgcaatggccttttgtcgagtcctcattccttaaagacgagcacacagcccttctactcacacccccgtctttgtcgtcgtacacacctctacagcatgatctgccgccgagacccgtccacgccgttctcaaagatcctaagtctacgcgtgctgggtgctttggccgtggtggttctcattacgataatgctgcttcggcttgaagtagtcgaccttgctcgccataccaaccaagtggcagcgcccaagccagcagcaccattatcaagctctgcgccttcaccagcggaagctccattaccagcagcatcgtcagtaccgccaccaccgccaccgccgccgcccatcacctatctgcacaggaatcaagatgaaaccacatccacatcgccattcaacatcaaggatttctgcaacaaagtgcccgcgccccgccatcttcgtgggctcttgatttccaaacctaaagaccaaccgaccgtgatctttatctggcgacaggcaacttttgaaagttacatcgactgggaaaaggagtcccggacactgtgcccgatcccactgtcgctgcagctattcttcgaccactaccggcaaaaacgcaccggatacactcaaccctgggagaacggatacgcgccgtgcattttctggaccttatcgttcaactctttcaacgatgaacgcggctcatgcaacaccccaacaaacgggaacatgacttacgttctcaccagcaactacacgcagttcgaggaggcagatattgtcctcttcaacttcccatacttcgagggcaccagcgacccgccatactttgacacccagtacatgccgccccggatagcgcatcagaactgggtttttcagttccagggagaatctgtcgggtactatcctcacactgccttgccagcatacctccagcaattcgatctcaccatcggaaccccgccaacgatggatatccatgcaccttattatgaggttacacccaagatcgcactatcgtacgcaaacatcaagcccggatacccattcgataagacgccagaacattatgtgtccttaatggtcagaaactgtggagccaaaaacgaccgcaacggtctcattgatgccgtcatcagtggcctaaatgcccactcgtacggagtttgccgaaacaacattcaaatccctgacgaaatcaacagacccggcaaatcttgggtggctatcaagcaggaaactctggcaggatatccctttgtgctcgcggccgagaactcgaactgcattggatacatttcggaaaagatctacgatgcgcttgcggtcggcgctatcccaatttacatgggcgcacccgatatcgcgaagtacgtaccggagggaagttacattagcgtggcggacttcagggactatgacgagttggtccaatatgtgaagacggtcgatcgagcacagttttacaagtggaaagaggttgtgaagaaggatcctagcaagttctgctcagggtgcatggtttctcataggaaaccagagtgcatcatgatggacaacgttcattacgtttaactggcacgcctgtacatgaatagaaaggcgtcatatttattacgttcatcgattgctgtttgcgaggttgtgtatttgtgtgccgttggcgtggatgaggcagttcgcacgtctaatgtctctgcaaagagctaaaggacaggagggggaaaaggtgccaattacaaggctttggaagaatgaaatggttgacagaagggacggggttgctggaaaaagtgaagcaacgtcactgtcacaagggccacttcagaatacatacggcctcgcacgttcctggatggcaaggttgaggttggtcctcacagtaaggttcaagacgttgatcgtgcgcacagaggaaatccgaatgtgcgaatgaaaagtctcgaccgtgagcgcgtttgcccgagcgacctacttgttcgctgatttttctcggaggcaaactgaggcggtgtatggcagatcgattatcatctcgaccttccttccttctgagactctcgccctccttctttcttgactcctcttgtttgcttcctcacctacactcactccctcatccataagcgttgcttccaggcttttgtagccacagtctcacctacaactacgccatggagtccgcctccgtctcctcagagcatgcgctcatccttcttgtattttctggcatccactttctatattttcatcttatcaaagcgtttgtgccctacatcgcatccgaccgcaaacgactttcctggatcctgactgtcaagtcgtgtctgattctcagcttgaccggatcctacttggcttacgacaccatccagaccacattctcaagacctttgccattcgggtcctactgcgacgtatctcacagctggtcgacaaaggtcttatggcgcgataggatgtcagcaagaggactatacagcagccacgttgttgcaataggacctgcgatgagtgatcgatcgacgcagcatccgggttcaacctggatcgttctgaactcataccctcaccgtccccagtatgcatggctggtggatcctgcctcaaccaacggatatgccactgcaacgctagaggttcaagatcagattaaggagctccattccaccaacaggacacctgctctatctgaatcagccatgggctgggtcatggattgtaaggccaccgaggaggaagcacagtcgagatggttctttgatctgaggtctacgccagcggatagctgggctggacagatgctgacggtctatttcggcagttacttgttgatggatctcgtttgtggttggctttattaccgcgagaaagtgaagctcttgacgggatggtttcatcacacgctgtacgtaggtctgtgttacaaggccctccacctgcaccatgctcatcttcttgcctgccatatggtcatggaatgtaaggaatcactggaagtgaagaaagaagcttaattttgtcatggttttatgtcagccactaatgcacaaccctcccctgtctatcttctctcccctggacacctttttcatggaaaaaaaaacctcgtctcagttccaacgctcttcctggggctaggacagatatacaagcctttccgtagtgatatcctgtttgcggttacgttcttcctgtctcgaatcctaatggactgtctgttgtcgcacgaggtcattgtgaatcggccagacgtccccctcagtctcaagtccttcatcgtgtttaagtctgccttgcatatcaagtttctcgtggatcttattcgtcagcagattcgactctggggaaagagaatgcagcagagtcatgtacccacagccaactttgtccacatggatgcgttcattaaaacagagaccgacaaggctgtccgagtcgaggagatttgctgcctttgatacaccatctcagaaagcgatggcaatttgcgtgcgagcaatcaagagtcaaactcgaagcaaagacagcgtttactgcgatactatcatgtccagaagccgaggcgccgtccatggagcaagggagcaaaaggcgaggatcgtcaacgtccgcgaaattgatttattcagttggcactagtgccaataaatagtaacaattctttgacggcgtctatgggctgtgcagccatgtagcacaatcaatatcagggcagtcgactagtcttcaatagtctttcaacaagcgcgaggtgcaagagtgctgcccacttttgttacggatttgcgatatgttgcgccgacattttacgggcaaacaagcaatgccttctacataaatcctgagcccaagcatgggttggaaggccaaaggcgaatggtggatgtgcatgcaaaggaggcgggacgaccgttggcgcttttgcattattgtgcaaaatcgattttgtgccactagcgcacaacgcaatgcctgtttttgtttggctgcgccgtgcacccaaatgttggtgaggagagtacaattacgagcaaagcagtgggaaagaactgtaaccttgtcgcctaatcgagtggcgtgcgcaccttgcaaaaattcgtcaaagcacccccccaattttctcagggaccgcacttgtactctaacacattcctctctcttttagatcggcggagaaatatcatattgtatacctgggtggccaattgagttaagagagcgctatcggattgccttccgcgaccgctaggtggctcatgcgaccagacccagggtggcaaaaaaaaaaaacattgtcaacaaaacgggccttgccttgcggcatacaaacaagtctatcaagaacgttcgcacagcgatggaaggatggacagttcgacaggttgctgtgcgcattaatgaggaggcgaaggcaaaggggcaatggaccgagtcctttgcccgagcacttgtgcgagcttcggccaatgtgtggctttcgacgtggactaattggcatcggagtattcatggggtactccctccaagcccgccgcgtcagtttcgcatcgcagtgcgccaaggccctctcccttctaattcacctgcaggatgagtaatggctgagaacaacacctgcagcaaggtaaaataatcgaaaatgcagaccccactctccgtaaccatttactgtaaattcagccatggcgctcaaagttcaatttcttgcagcgttttactgcgatccgcagtcgacagccacacaactgagtcctgagtggcggatatattcaacttccagctaactctacgaccctttgcacaccgcttctttgtgctacgcgtcaggaccccgtctatttatattgaaaagaaaggaaaagaaaaaaaaaaaaagcggcgcgtaaagtctagcattcactggctcacaagggcggctctttccgtttttttttatcatatcaaaaagttaatgaacaaaaacaaaacaaaaaacttacagaccgacagaccgagccaagtttttgactctccagcctcgcccctcgagggaaggagcgcttgcgagagtcaagctgatcgttttacataccgatgtctcacggcgtggaataagtataaataccaaaggcccactccttcaccgctggcttgaacagttaccattttccacaacccacagccgaacatctcctcccgagcttcagtctttctttgcctaggtttcttccgctagataatccacagcaactcaaacccaagaacaaaaatgcgcatttctgtcattccaggtcttttggccgtcaccgccgtgctggctcttgtccaggccagcgcccccacacgcacgacagaccacgtcgatagacgcgcggtcgaggaagccatggccgttgcccctgcacctccagaggtcaccagcaacaagaagcgctctcttagaagcgctgtcaagcctgcagcaccgccacaagtcacctgtaacaagaagcgtgctctccggaatgctgttgcccccgcaccaccagaggtcaccagtaacaaaaagcgtgctctccggaatgctgttgcccccgcaccaccagaggtcaccagtaacaagaagcgtgccctccgggaccctgttcaccctgcaccaccagaggtcaccagcgtccataagcgcgctcttaggaaggaagcctttgctgctgctcccgcaccaccagaggtcaccagtaacaagaagcgtgcgctccggaacgctgttgctcccgcaccaccagaggtcaccagcaacaagaaacgtgcgctgaagaatgctgtcaaccctgcgccaccagaggtcaccagcgtccataagcggtctattggcagcgtctccaaccctgacaaaccacaggtcaccagcaacaagaaacgctacacgacggacgagtatgattgtgcagtgtcggatgtgacattggaggcccacaggcgcgtcgagtgcggtggatgtgtagtcaagaacaacaacggcttcaaggccacgcttcttgtggcagttcaaggacccaatgtgcgcaagtgcaaggcgttgccccagggcgattgcctctctgagtatggctggcaatggtgccgcaagtgaagtagtgtcctccccatcaaaaaaaaaaaaatagtcaagagcattcttctcaagcaaaaagcatcatagacacatctctcactactctttccaacattaaacgatcactgaatgaaaacacgcctcttctccaagcctaaatgcattgactgtttcacactgcagagtagatccatatcttccgaattttgggagctgagtctaaactggaagggattcagccccataggctatcatgtcccaagatgcgggcacagagatgggagaagggcgaagacgtaaaacgagatgttggcggtacgcattgccctattttgacaaccgatgcataccgttggaacggtttgtggcactgaaaaaaaaaatctgggtgcggaatagaaatgttgaagggcctgaaatgttgaaggactgctgtggtttggtgaacgtgcacaaaagcgtgggcaacaaggcaagaaggagaaaacatgacaaaagattagtggatgcaagtatcgtgagagttttttttggtatattactgtacttctatgctaagcttggaggcatggtgcagcatggatgtatgttcgtgtgtctgtgtgtatctgtgtgtatctgtgtgtgtgtggaacggtgcaccaaagaattgggagcctcctacccacctcattcgatgaacgggtgggctgcccattttgatcacccattttctgcaatatattccggtatctttagtaggtattcattgccactatctatcgacttatccatgcaagcgcggattgatctgcgggcctcttcatcccagacacaaagcgcgagggcgagcgcttagccaatacgcaagatctaatcgcagcgtatcgaggcatgtattccgcctgcggtgcagacacgcaccaaaaaacggagcctctgcgccacgttctagaacctaggacaccgttgcgctctgttgcgcgctccagagagtacatcttggaagaccgtgtgaactaatctaccccgcggaggaggcttggatgacgcgctccctagttccaagtatagatcccgcgtctgttcaatgcttttgctggtgtcattcatccagcggatgagtataacaatctcatgcgcagtgtgaggtctgcacgtattgttgatatgtcgtcgttgctgatattgcgaaatttgcttgccgttatcctgaacagtacactttttgcaacctctcgatgcaatccatcgctctcagcgtgttttgaagtcttttgctttcttccagttttttgtggaccatccagacagttcccatccagacagttcactcagcgtaggtaacagcatccgatgaaaacacaagaaaagctgtgtgggtgccatggtctttattcgatgcttccacaaacaacaacgtaaatgagagccgagcggtgcgatgagacgtatggttctttgagccgacagataacttcgctttctgcagtaagcgagtcgagaacggttggcagcctgcgaattcactcgaggcatagtgcggagtcgtcctgttttcttgcccttcccaagcccatgcggagcaaagtcctgccatatccgccagccctccaggtccagcaagacgatagattgcgaaagatcgagtgaaaggctgttgctgctggttgccggttgtttgttttctgttgttgtttctggtatcttccttgatgggtaaaccggggttttcctttccgagtgcggcgtccgtgtcatccaaagctgttaaatcttacagactagtccagttcctcatgctccctgccagagtttggactcgttctcgatgatcacagaaaaccgctcctcctacggattaatgaaagacgtcagccaagtcgacaggcaacactggggaaaatgtaaaaagtaaagcatgaggtggacaacaactggcttgattgagctgaggctgaagtatacctttttcttgatcttcagagcctccagcatgtatgctgttccaaccaccagccctacagcgagggccgcgcgcttgcttgatttcctgacgaatggtcgcatcgctcaagaggagccgagatggggaaaaggatgattctgaggtgatgcgggtttgacggaccgaaagaggggttgccaagtcaatgcgaacaaaactttcggaacgagaaatgtgactgcctagaatggccctttttccgtgaccttgccgcagggcccagggagctgtttgaaattcgtcattcctgacggtgcgagagggtggcgagcaaatgtcaagctgtcgaatgcagtaaactttaaccaagtgtggcaagcgtgattgaaggaggcccgcgtaaagcgagagaacaacctactgctctccagctgtatcggtttccacgggagggaggaagcagagattatcctcaacacaaacgaacattcaggtctgcagtctgcccccgcctctttctggctcaataatgatgaacgaagtagccttcatcatgcccattttgatttactacgactgatatttatgtctgctgaacagtaggcggcatgggacgatgcctagtgctacgaacgcaggacgaccacttaccgtggcgtgctgcagcacaacgtacgtccagttctggaggatgaacgacaccttgcctgccaatgctcgcatggcctactgctcccaggctgcgctgaccgacaccttcatgacgctctcagagaccaccttgttggagcaactgtggccgaaggctggtcgcttggatctctggcacagtcgcaccgaggttcggcagatcatggacaagatcttgtctcgcagccaagccgaagcgttggtcaaggaacacggcaccttgacgcgaatgctcttctttggcgatcccgctcccaacacgggcagacgtccaccggtctgctcctatcgccgcaagttgatcacagcaaagcagctcatgaaccacatgaactcgactggcggggcgcagaacccactctcgcccgagagtctgaaggcccacaagtccttgctgatcaggtattaccgggatcgaaagaagagcagagaagatggtgtgcctttcgatgagccagtgcctgcgctgctgtctgaccctgcgctgcccaggttctacgtgccattggggatgatccgcacggaagggctcgagctccagatattcgcctatgatctgcggaaaccatgcacccctcctgcaaagtacaagatgaagaccggcatcaaagacatcaaggactgggagactgcagccgaccttcaagcggcactcggcgatggctatcgctcaatgcctgtcgtgggcatcgacccgggtgaggtggtgaccgctgcaggatgtgggatctacatcgtccctggctcgcccaacaccgtttccacactcaccatccagcgtacagcgctgtatgcgcccattctgcgcgcccgctatgcgctgaacttggtcaagaaggagccgttgcgcatcacgcacttgcagccacctggccatggtccagtgaccgttccgtccaccaacgactggcagaacgagatagttggcatggtggatggatcgatgcagtcggcggtggaccatgtcaaagcctgggggagagcataccccgctctccggaccttctatgcgtccaacgcctacaggaaaaacaattgcgctcgcaggaatgcttttcgcgcagagtacgattgggcggtgactggacttctcaagttggggctcgacaggagcagtgtggccgagatgcaaggggtgcacaagaaggtgggcgtaggagggaaaaagaccctgttcgtctatggagatgccaagttcaacactcggactcgcttggcttctctgcattcgtccttccaagggtacttttactaaaggtaagcttgtggttgctcatgcacattcaggaattggggagaatgattcgttcttgcagttaacattttttttttttttttttttttttttcgtctctcgtgtcactctacaggcaacggcgctagggcatgccgttgttgtcgcggacgagttcaggacctcgtcgatatgcccgtcgtgtaatgcatgggtggccaagccatcgatgcgagcgtgcttctgtgtgaacccagcatgtaaccggtacatccaccgggacatcctcggtgcccacaacatcgctcgcatcaggaaacagtggctcaaccaccaagatcggcctgctgcccttacacgatcaacatagtcggaccgaaaatccgataacaatttatagttgtaagtattaacacggacactggcaacctcttttccacaacaaagcatgccttcacgtacactaactctaactttcttcacattctagcttggcctggtagcactatagaatggccccaacagctgagactcttcagaatctttttatatatatatacaagagcgcaaacgaaggctgtgaaataggaaagcgatggagtgagggccgtgagaacaggtgtgatccgcaccagagtagatgcaagactcaatcaatgaccatgatacgcccattcgtgggtgaagtagcgctgggtgattcgcgggcatcacgcagcagatgaggcttgagaccctttccaaagttacggtaacagatcgtggcgttggcaatggtggccaggatggtgataaggcagagtgatgctgtgcagcatgaacgagagcgagcaggggagagagagaagtcagtgagttgtttttgttggcaacagacacaactgaagcctgaaacaagggcacacaggatgttcagaggatgcatgtagcgtgtttcttaccaaagagtgtcaggaactgattcacgcccttatagaggggcgccttttctccaatgtacatacgaacaaccttgaaaacaaaatacaccactcctgctagcatcgctaccagaaaagtagccatccactttcgactctcgtgacgaaccgcgtagaccgcgataaacagaatcaggaccgtcagcgggagaacaatgatggtcagccagtattcagggtcctggccacgccttgtcagggcgaggtaaatgaactgaatcgaaaagccaacgaagaagaacaagtcgaccttgatgagcaccaagtaaatctggtaggcgcggtacatttctatgaggaagaaaaatgtgcatcggtcagtgctagtgacacaaatgatagccctagtggtgcctctcgaagtcttcatcgcctgcttactcttcatgttggggtccgctccaatctttttgtatattttccatccgaattcctggaagagctggtaggccagccaagtgacaaggcactgactgatgccaatgacacagacgtcaacgatcaagaacggccgtaaacgggactgaagctcggtagctctgctgggtggatcaaaaaatccggccgcacctccgttctcaagcgagttccttatctgagagatttcaaagatcgaataggcaaagcagcagacattgaaaatgactatggcaatgagctcaatggtgttctgggcacgaacctagaagaggcatcgttttgtgtacggagacagcaagaaggtgtcaaagagattcgctgtgtattcaggcatgtgtcaaaagtcgggtgcacacacacacacacacacacaagcgtaaataggagtgttgtccaatcgccagcctgggtctgttcaggcaccagggccaaataatttcaaaagacccatcaagggatttttcgagaagaacttacggcatcccaagcaatgacgagctgaaagatttgtgcaaagacaaacaccatgagatatgcgggaatggacctcgactggtttcgagggtccaggtacggtggcaagttcacagtcgtgataacctctgtcctctgctctggcgagacgtcaacaagactgtcaaagtacagcaggacaatcaccacctgcatgatgatgacaaggactgcctccacagcgacaaccaatatcatggcctttccgtacgttgagcacgggaacctcacgaatcgtgccagtctagccttgaatgtggaatcgctgccatcagctcctgagggagacagctgcgaggtgggggagtgcgaaggctggggagggtaagagtagtacgaaggcggcggctttggttcacccgtgttgccgaggttctgggctgcggctgttgctgttactgctgctggtggcactcttgggacacgattctggttctgattgtgagtgcggtgctgactgtccagttgcagattcatccgcagagaatcctcggcctggatttgttcctgaagccgctgttggtgctgcctttgaagctgcagttgctgctgttgctgttgcgtgggctgcctcgtcatgccacgagtgttgctgtcgccgttatggtgggcgttattattagttgagtaggtggtcggagtgtgtgcgaaattagtgttgtcattataattgctatatgatcgtgaggatggtgatatgagcggggaattgtgtactggcgtgtggtcgtcgatgtcctgatagaaagctcgctgttgctgctgctgctgctgcgcgtagttgccggtatggttgtcctggccaggaccctggttgttcatgggacctggcatcagagaagcttgctgcgagaacagagaaggagcggagcgagtggacggtgagtgcagtggacaggcagaagcgggttgcagaatagagaagcccagatagtgtgagaactgtgcgcgtagaaaagactgaaagcgaggagtggagtgaaagaaagcgagaaaccgaagagtgttcgagtagcacgcactttgtttgttgtcagaacacaacgagagcacccaccctactccaccctcatcacccgccttgctctcgttcctcgcctcgcggctgtcccccggacagctcgtcccgtggcccacttcctcgactctttttttttttgcgggctgtttctacttcccatccccttctgagtcgcatgtctttgacaacagcccgccattctgcgtaccaggggttcccacggatactccttcatcctgctgtctgcaaggacaggtcagtagcgacctgcaaaaggcatccctgagaagcattgtggaagcggtgctgtcgacactgtccatcctgccccccttatttgtctgcgtgtctgtacaaatatgcactgttctccatgcggtttcgcactttgtggacatttccgcgtgcagggaaggaaaaggacgcacagggcattgacttacagagtgttgactggtgttgtcagacattgtgctataagagtgcttcaagggttggtcagggtcggacacagtgcgagtgttgtgtgatgcaaagaatgagatgaggaggctgattcaaaaccagatccatggacgaaacgtagagaggaaaaaagaacagggagtggtaggccgaggagccgagattggagagaggcgttggggaacgggcaactctttatagattatgtagacttcaccgaggcatcgaacgcggggcaagaacgaggtgagcacgagggggcgtagcgtcaggacgaggggaggggggtgcgcgggtgggctgtgctggccgttggccttcagctgtggaccggagcgtatcacaactgctctcatttttcttttcgttttctgtggtccaaagcacagaggtcactgtggaccacagagacaagaaacggcgtccctcaattgccaccatcccaaaagcttcaccactgcactggacatcctcattccggccatcgcaatcatcctagccttcctctctactctattcatcgattaggcaggggtagttgaggatcggcgctttcgctttgatggacatgacctcgtcctccaagatccaggctcagagaggcacgggaacgatgacgatgaatgcaattatagacctgcagctctgacctcggcgccctctgacgaaaccgagacggatgaacgcacaggtgggctcagctcatcgcaaatcgatcgatacttctacggtccaaaccatcgttaattgcattattactgtgcttcccgttcacatcattctaaacttgcttttctccgaggagggcaggatttctcgaggtatgggcgtgtggtcgaaaatgcttcgcagagcttgcattttcccgcgccactttggtcaaggtcgccgtccatgtttgccttaccgttggctttgagacggacagaggtaaaagtcagcctgtcgccgttaagaaggccttgacaagagctgcgaagagttgacgaagcacgcggaagtgttaacttgatcaggtgtttcttcagtccgtttacagcagacgacacaggaacttcttctccatgccacatagcatacgagcgggacggtgatgcgtcgttttcgcgaactcactgcaacgggtcgaatatcacgtacggtacctaattcgtacgtgactatgagggaggcgaaaggattcaaatcgtgcgcaatccttccaatgacactctcccatcccaccacgcgtaccctttcgaaccccttgtcaacgcgtctcgatatcactctcatagcgggtcgtcgctctgtattgaggactatcagttaaaagcgccttagccaggacaacacgtagacatgtcgaccgtcaagatcaatctcaagaatgcaaaggaggccatcgtggccaaaaaatacgaggaggcgctaaagtgggcagaaaaggttctggacgcggatgccgacaactacatggggtacgtcgggctgacatttcaacaagatcccaacactgctatccgtactttcgcctccgagaaaaccagtgtctcattgaacctcctttcattatacaatgaagcctggtattttcaggtctagcacatcagaatctgggacaggcagaaaatggtgaggcgtccttcaaaaaggcaattgctgtcagtcctgatcttccgctagcacgcgaggtaagcatccaaatgcgaagctgtggcctactctgaggaaaaaatcagccgcagtctaaacgtttctccacgtataacagggcctgatcaacttttacgacaaactcaagcggtggccggacttgattgtaactcttgaggacatgctccagatccatttaaaaacgtaacgagaagtgatgttcacaaatctgaggatcatttacgctatgccgatgaacaaatattgacgtgtagctacgctcaactgtgtagtctagatggcaagaaggccctgtctacaacccaaaggctgattgaactgtataccaacgagggacggatggacaaagcgattgagaagatgggaaccttgttgccaggaagctctctttacgacatcttggacgataaaccaaatcacatggataccctcaagtcaatggctcacgtccaagaaaagacggacgccgaatttttcgagcgcgaagtcagactgcggcgaggacgactgggcggggggaccctggagcaggttcaaaatgcggttcgaaacgatctatataataagtcagaggtacataacggcttgctttcggctaacaggctgttaaaagatgcagtcactgacatacgctaatccttctctggccataatagcttggagcaacatacgagtcaatcctacaattagacgtggagaacaaccgggatctagagctgaagctgctagagttttacatcaacaaaatggaggctatcaggaccgaccaaaagtccactgtgcgggagaaagcgatggcgttggcatccagaatgattcaggaaaactcaccatcatcgctggcttacgaagtcatcttcaaattcaccgatgctgcttcgcccacagattacgatgtggagttgcaggagcaatatattacaaagtatcccaacacaggcctctcaaagatgatccaggcacaattacacttctcgcaaggagaggctcgagacgatttattggagattttggaggaaggattcaaactggaccccagcgtagcctatggatacttggtcatctgttggatggatcacgatgcccacgactacgaagctggactcgagcatgctaccgcgggcagagatatcatccaaaagcaagcaacagctacagcgcttgcgttttccaggtacacatcactatccgtgcaaaactgaaaagcatattagaggtggtactgtgttaacctctatttgacatttgcctaacaggatgcgccgatcgtttgagctctgtatggcgaattgccagctcaagatcagtcccaagctggctgcgagtgctcttgagttgtaccaagggattctcaaggaagatagcaccaacctcgatgcgcaccaggtacacgttgcttcttattgatataatgccttcaactatttgcggaccaagacttacacgtccttttttgtactggtggcgaatagggtgtcggattcgtaaggttcgccgaaggcaaatgggctgaggcatcagactcctttgagagagtgcttgctctagatgcaggcaatgtctcagcaaagtcagaactaggatggattttatacctgcaacatgagtatgagcgggcagaggagcgtctccgggaggtcattgaaacatcggaagaacctcgcgccttggacctataccgactaggaagggtctactacgacctggggggtacgtcaaacttgcgatcttgaccataaggataggctgcatgtacttgggcactcacacagtttcgatctaacgtagacgagtatcgggagaatcctgagtacagtcatgcacagctcatcgccgcggccaaacttgacccgcgttgtgcaggtgcattcacatatcttggacattactatcgtgaggtcattcaggatgaagctcgagcagagaagtgctatcagcacgcattttcgcttgatccacgtgagggagatgcgggacgtttcctgagcgactatctattgaagagcgacagtctggagggcgcaatcgatatctaccaaaaggtcgtggatgctgatggcaaagccaactgggcactgaagagactgggattcgctgacctgatgcgcggcaacaaccttgaggccatgggttctttccaaaagcttttgagaaacgacatcaaggatccgctggcgtgggagggtgtcgctgaggcgtaccagcacgagggtcgatacatggcggctctgaaggctttttcaaggatgcgggagctacttccagaatcgaccgttgctgtctaccatattgctcgtgtgcatcagagactgacgatgtaccctgaggcgattgagcactaccatttggcactcgacttggcagaaaagaaacaggagcccaagcacgtcccgtctttgatgggcatggcggagagttatttggaacagggcaaggagttttttgtgtcgggatactatggtcgatcggctgaatcatgcggacaggcgttggtgtatgcgcaccaactactgcaacttgacaaccaaatcatgtcggcgtggaagctggtaggcgacgcttgtttggcgtaccgctcggttgcaagatacttacgactctgcccacttgagaccctgtcagccattgtccacattcttcctgcagacaccaacgcacttctgcacatccccggacatctggacagcaatcttttgcagtttttcgagactgctcagccatccgacctgatggacgctactacggagacgacggcgcaggcactcgacgccatttatgccatcgcaggactggcgtataaaagggccaacattttgcacgggaacgagggataccagtccgcccaattctggtacgacatcgcgctaagctactactttcgacatgagaacgctgtccgtaagaaccggtctgccgaggctgccagtcgagcgaagcaatggctcgggatcaccatgcgctgtctgaaggcgtccctgcagttcgaggaggagaatccaatagtctggaatgcacttggtgtcgctgcaatgtcgaccaatgccgagatcagccagcatgcgttcatcaagtcgatcgagtatgaccccaaggtatgtatcaatggaaaaaaaatcaaccaatattgcacatattttctatgtttcctggctaacccatcattcattttgacctttgcgctctattttgatttaggatgctgttccttggtctaatcttggatttctctatattctgaattcggaattggagcttgcattgaaggcgtttacaacagcgcagactctggacccttcgttcgcacaagcatggactggacaggcgtgcgttgctaatctctggggaagcggagagtcgacagcgctgtttgcacatgcgtacgaatctagtacggcctcgatcctggaagcaaattacggatatgctgccaacacatttatagacatgatggcgacctttcagagatcgagcactacaggcagccatgtaggtggcaaacaggccggtcagttgacgagttcgagtcttctagtgacaccggcgtttgcgctgtcaaagtacttggaacagaggccacgggatattgctgggtggaatttgctaggcctcatgcgggagagatttttgcagcaggagggagcagccgagtgcttcttgaccgccatcaggatccttcaggaagaggaaggccaggataccagcagcgacagatgcaggagggagaaaatgatgcttcaccacaatttggcccgtgcactgttgtccattggagactactcgggagcagtggaggcgtacgaaatttccatcgagctggagggtccagaggctagtccgaatgtgataaggacatgcaaacacctcggtgcaggactttctctctattacgcaggcgagttggagcggagtctggccatgtttgagacggcgctcgcggagaccgagcaagtggagggcatggagaagtctcgagacgatgtggtcgtccttctgagtcaggttctgtgggctcttggtggggatgaacagcgggcggtggccaaggacgagctgttccgatgcattgcacagtcaccgacacacttgccggcgatctttggcttgggtgcgatggggctggtccaggacgacgagaccctcgccacggctgcattgaaggagattctaaagttttcgagaatggagctcgcagagatggaccccgagatgcagtcggacaggatgatcagccagtattacttgctattgaatgagtccaagctgtcgaccatggcgctttccaagtcggtccaccaggcacctgcggaagccatgctttggcgacgactttcagagcatgtgtcgacgacagcagcaacgcatggacagagcccgaactcggtcgcacaagcgactgcaaaggcgagccttgacctgctccctcagcgggatggtgtgcaggcaatggacctttctgagggttacggtcaacttgcgggcacgatgctgttggcggatgaggagaggcagcagaaggtgagcgggtggaagaataccaagaaggagaagctggacgaggagcggcgacagagtgcagccaagatccgcgatgcgctgacggttgcacagagggcggtgatggccgcaccatggaatcacaaggcatggcaggtcgtgggcgtcgcggcgcagacacagcagcgcgtcgatgcgtagagtggtcgttgaaaaaatacaaaaagtgttgtccgtatagaatgaaggcgaaaaaaaggtgttcttttaggccgcctgcgtctggtcgtaaaatcgtcatctcttcaacccgattggaggcgttgtttgcgcatcggacgttgatgcagacgcctgacgatatggctttctgcggtcgcttctagtctctcgccgcggagcaaggggccaaggccaagatagcaggtcctttacccagtgttggatgcggtgccagctggcatgtgtgcttttttgttttcctcaaggttcagtgccaccccaatatggttgtgcttcttttcttcttttgtgtctcagacgaagggttcagagtacagggtggacgtgcgagggcgagcgaggtgggtggtggatgtctctctctgggtctcgttttttttttatgcgaatcacttgaatcacatgaatcacttgaatcacatgaatcacttgaatcacatgaatcacatgaatcacatgaatcacattatcattgtttactcctcttcacattcgttgcttcacattcgtttcttcactcccactctttttgcaccctctggacaccctctacgcctcgagtgactagctcatccgacccgccagccagccagccagcacgcaccagctcagcccagtccagccccagtcgctgctcgtctcagcgcgcactgcctgcattccgcaccaggcgcagccatctccacttcgcatgcccatccgcagacacatcattgcacagaccgcccgaccttccaatgtctcagcaggaccatccaagagcagcactgcccggcctcaactcatcgggagccgcagacagccgcgtgcgccaggagcaagcggacctgtccagtgtcgaggaccatgacacacacagccaaagtcagacgcctcggcctcctgtcctcaacccgtcgtccgcttcccctgccttggtgtactatcctatctcggcatcgggatcgtctgcagcactcacagctgcgcccttgagctcgacagcccgggtcgttgacgaggacgtggacatggatgatcagagcaacttgggcgttgtagccccgacagaccaggctgcgccatcgtattcagccacctctgcagacaacgcgcaggatcgaggtttgtcggcagtgacggcggaggcggatgctccgtggacaagtacctcggatcgtgaacagacgtcgctctcgaccatctccagtgcccgccgttatccgtcgctcacccttcgagcggcccagcaccaagctacgcaatctcttcacaatcgccctgccttcctacccttaccggaacgcgaggacacaagtcgtcctcggtccataacctttggcactctcaaaaaggcatccatggccagtcgaaccccctcgacctcctcattcccaacgggtaaaaaatcgaaaatggcacagctgccggcctacctacgtcatactacctttgcccagcatttccagcctgaaggagtgacttttgaccatactgcagccacgtcacccacaggaagagagccctcgaaacgcaggcgcctgctgaatgagtctggaagacggcgacactcgcacacgtatcaggacagcgacagtagcagttgcgacagtagcagcagtagtagcagcggcagcagcagcagtggaagcggcagcgagtctggaggcagctcgcacgggaatgatggtgatgcgcatgcagagcgacgtccgctcaaataccaccttccttcgcgctggagttcggttgaaaagactgagaaaaccatgctctttgaggatgatttggaggtccattacacaggtgaatatcacgtcttggcgaatacggatattatgatcgcgaaacacgctcgtgtgtttgggcgttcacttactgttgtgaatttaatacaggtccgggcaaggcggatagcgacgcatcagcgatacgagcgaacaggcccattccaccgcaatgcggtgtctattactacgaagttttcatcaagagcaagggactgcaagggtaagactgcttgcatgcatatcgcttgacccctttctaaactgcataatcgatgcttaaccagtctatctgctatcttgatgttacacgaaccagctacattggcatcggtgtttgcaactcttctgtggtcctcgaacgtctgcctggtacgctgtggaaatttttgatgagtacatgctgcgcacacacgaacttgatcagtctccgctgcgtactaaccataacgcttcttaatatggtccgaataccacttttcgctacacttttcgttacggatggcgaacaggatgggagccgcagtcatggggatatcacggagacgatggcaacatctttggtggttgcggtaacgggcgcccgtttggacctattttcacgacaggcgacacaatcggttgtggcatcaatttcagagacatgtcactgttctacacgaagaatggccagtttctcggtaagtaaatggagtagtgatctgtgctgtttctcctcgtacgcgcttggcgaggtattctaattttgcgcatgtcgctttgatcgtggtaggcgtcgctttccgcgacttgaggggttctctttacccgacagtgggtatgagaacagcaggcgagattgtcgaggccaactttgggcagcgggactttgtgttcgacattgaaagctatgtcaaggtacaacatttatccgttgctcacgtaaagtattgactgatgcatctagagctgctattgataatatcacttgcacgtattaggagcttaaaactgaagcctggcaggagttggagaacacgttccaaaagacaatcgacgagaaaaaccaagtgggtgttttatcgcaaagtcttagtcagttggtgctttcctacatgattcatcatgggtattctgagagtgccaagcaattttcaagtgacctggtcccccagtcacaaagaaagggagcttcatcatcaggacccaaggacgcggacaattatccattggttgtcgatacagagaggcggaaaggtatttatctatgctgacttccacccagagagactctgcatgtagcgagtagcttaatttagaaaccctatctcctgggtaagcaattaagcgttcgctcgttcttgacacttcatagttattcgaacggccattctcgcaggagatatcgatacggccatcgagcttctcgaaacacattatgctggggttgtggctagccaggaggacatgctgttccaacttcgctgccgcaagtttgtcgaaatggttgcagcgtcctcctctccacttcaagcactggaccgccaggaacaacacggtggcacgcgaaaagagaggcatgacggcaaaatgattgagagtagcttgtccatggatgtggatcaagatacgtccaagaaggaaggtttggtggcctctcgctcgcaagggaactacgacgatctggaaggcttgggtgcactcaaagacactattgtgtttggacagtttttgcaagagcagtatgggcacaaccggcgggagtctattcagcagacgttacgcgaaacgttttcggtgctggcctactcacacaactcgcacagtagacactcccattcggcttcatcaaccgtccatcatccatcgaagctatcgagaccggtttctcgggagaaggtggccgatacagtgaatacggctgtcctcgcctcccaaaacttgccaacgacagcaccactggagacggtttatcgccatacgcatgtcgtcctgtcagagctgacgaagcagggagtgggagaggccgcgttctttgacctttacaaagattgtctgcagtgattaagccctggctatatgcacacagcgatagactgaagtacttccataaagacgacgcgctaccagtctccgacctttttttattttgagaacgatgccaatacggggtgccatgcgcgcaatgtgtactcctgcgcagtcctttccacgagatgcgctaagcagaagagtgaagtatcagacgcgcactgttgtgagtcaagacgagcacgcactctgctgagtgtgaggcgttacaacatcagaccaggatgcaccaaagtgccctcctttgctgctcacacaccttaattttagcctcagtccctcttgtgctcggtatgatgcgtgagaatgatcgtcgaaaataggctgccgggtgccattggtcgcgcagttttgtcggttccgataccgtgtatgctctgcagtccattcttgctgcaagacgccgctgaggcaaaagctaaactccactgaggagctccctgatgcgagaaggttcgctgcacgctggggaattagtggcgttgcccagcgcgcctggcgcagttcagaagctttaccagggctgaatatctgagtttgacccgtgcccattgccccacgggtacgataagaggttggtaaacgagacaaatgtatgtagcatgtttcatgaacagtgcaatgggcagagaggcttacgcgtccatacaagaacgaggaaccaaaaaaaaaccataaaaaggcataaggatttgatccttacccacaatttattctacagcatcgcaattgtggcatcaccccagcaacaggaagatatataaaaaaaaagatgaccttcttatcctcccgcaagtctacggccccgactactgctgctgctactaccgccggtgctcctcctcagtccccgactccctcctctctgccttcatccggctcccaggtcacgctcgtagacgatagcgttgttcatcaagcagccatgatcaaggcttccaaggtcgcgaatgctgagaacaagggccttctttcgaagggcaaggaaaacggaaccaagccagcctcagacttcaaggtgtctgccatggcgtatgtggtcagccgttcttaaagcggatgctgacgctaacttgaaactgacagacctataaacaaagtcggacccattttatgcgccattcatcactgccgtggtcaatgttcttaatttctcaggaagagctcgcattgacttcaattatttattcatcagcgatcgttcttgcgatcgagtatcggattttcaagtccacaggggtgacgaagacgtgaaaaatgcatgttgtaggttctcagggagtattttagaaagagtgttgtttttatatgcaaagggttcagtattgatacaaatgggagatgcagacgcagatcaaagggatgtgtgccacgaatctatgagcgactgatcgcaagggccatagctgaggttttgtacgaaggctctgtgcctgcagtcgaggtaggcttgcttgaagactgggtcttgaaacctgaggagaaccattcgagagacatggatgatcgagggctactgttggatgtggcagtgttatcggaggcagacgtcttgttaggaacggacttggaggcgttagagaagatggccattgtgcttgattgcgtgattgcttgcttgggggttgagatcggtttgaaagtgcgtgggggacggaagaaggagatcttgaactgaagattgaaagttggagacttgcttgttgcttttgtgataatgttcgccctaatgagcaatggtgtctccttttatacacgcacaggcgtcatttctttgcaactgtaattgttctctatttgtcacgaacggcggtggggacatgctgtacagtagagttgtgttttgcttccattttggctgcttacattgcctcccatattgggacacacacacacacacacggcgtgcaaaaccgcaataaggttttttatgacaaatcgtcgcagtcggtgcgtcaattgaccatgacacccctaatatttcagcgcagcgctgcaatgatcgggcgcaacagagtcaaagcagggatcatcattgtgagccatagatgcaccacacatcaactcatatgtgctaatgtgctgctgttgaagcaacgagccgcagtccaggcgtataaagagccttgaatgaggctgcctgtcactttcacctcatcatcatacagcatttactagtactcaagaacactacttctccaccatctgacaaaaagcgcaagtcaaccatctaaagcagccacaagactccccagctcctcgcattcaccatggctatcctcaacttcatcatgtcatcttcaagcaagaacaaggtcgcagtcatttcgatgtctagtgaatcaggcacccaacctccaaagtccgctacattcaagaaccatacaaagaagaacacagccgatgcaaaggtcatgcccgagttcaaggtgtccgctatggcctatgcttttagccgcgtgtgatcccgtgtagatgtttagcaggagtcgactctttttctgtatttttaccaaacgtaataaattcactgtacacttcccacaccaagaaattgactgaaaaatgcacgcaaggttgcgcctaggtgatggagcaacatattttaggctgtcgagtccccaggtattctgaacagggatacgtctcagctcactgaggcccaaatcgctactcgaacctgccctatctgaacttaagcaggtattgggtacgtacacagcttaaagcggtcggcattatatttatgggtgccaataatcgtcacctgagcaatggctcttgcaactgtatgcagcctcgtactgatcaaacattgctcaagtttctaatcttggtcaatcgcaagtttcgagaaagatttgtctttaatgctgagggttcagtaatgttacagatgggatatgcagagggtggtacagaagaatctgtgctacggtttatgagttacagatctatgagcgactgatcgcgagggccatggccgaggttttgtacgaaggctctgtgcctgcagtcgaggtatgcttgcttgaagactgggtcttgaaacctgaggagaaccattcgagagacatggatgatcgagggctactgttggatgcggcagtgttatcggaggcagacgtattgtaaggaacggacttggaggcgttagagaagatggccattgtgcttgactgcgtgattgcttgcttgatggttgagatcggtatgaaaatgcgcggaggcagggaggagagggagttcctgacttgaagattgagagttgagtagcttgagctgttgcgagataatgtcagccatggtgaggagtggtatttccttttatacatgcgagtcgtcatttctttgcaactgtcaatttgtcacgaacggcggtgggatatgccatgtagaagttgagttttgcttctattttggctgtttgcattgcctcccattttgggacacatacacatacacggcgtgcaaaaccgcaataaggttttttttatgacaaatcgtcactcatctctctctccgcttcttgtcaattgaccatgatgcccctattttctgcttttgttgatgttcagcgcagttgcattgatctggcgcaacagagtcaactcacggatcgctatgagccatagaggcatcgcaccttaacctaatcatgctgttggccttggacgatgacacccctccaagattagaaagcatagtagtagcgagccgcagtccagatgtataaagagccgatgcaagaggccttcagtcattttcaactcatcatcataccgcacaataccagcactcaaagaagctactcctctacaacctgggaagaaacgcaagtcaaccatctcaagcaagccacctcccgcaactctcaaactactcccatcgaccatggcgattctcaactttatcaggtcatcttcgagcaagaacaaagtcgcggtcatttcgtcgtccgatgcatccgctcaccagtctccaaaggcccccacatcaaacaaccctataaagaaggatgcatcgaaaaacaagaccatctccgagttcaaagtgtctgctatggcttatgcagttagccgcgcgtgagcacgcgtaacccagtatatgcctagcacccctccccttctcatctctcatcatatgtacttttaccactttaaaaataaatccgctgaaggcgcgcaggacaagcgcacaaggaatgcaaacattccccagagttgttgggaacaccgcagtcactttagatatatttcacagccgaaatccgctgtatggtctattgttttgaggtctgttgtttccttcataccgtcttctcattcctatccccatcctcaccaacctccatcgtcctcggctcgtgctcagcgcaggcccgactcctccttcgcaaaccgcaggtacacgcattgccatcattcttggattcagatgagttgacatcataaagaccgttctcctgcaacgtaccaagcagtcgcagtgagggaacaccgtgcacgaatgctgcatacacggttgttttcgcttgggctcaacgaacgctcctcctcacgcagccttcaacttttttatattagactgcaggggcccactaggtcgaagcagctcgagcctgccctcaccgaatgaagcggactcatggtacagctacagcaccgagccggtccacgtggagccgcgctaataagccctttgagccaatgcactctgcgttcccagcagacggacccaggaaagcagcagtggcgccctccactgcctatgtatctccccgaagtaagctgactggaacctgctttcagaaggatctgtagcctcgtaggttttggcgagccgagttttaatgtccaaactggattctgccatccacatccatagctatcaaacaggccgtggctgataacaacgccttcttgctaggccagagcctttcgacgtccttcatgaactacatcgaatacgagaaagagcggacactggggaacgtagctgttatacaggacaccatcgcagcggcgctccgactgcatgttgatccacccatgtttgtcattaatgcgctgatcaccgttggcacagtgacggctatcaaggacctggacgcagactttgagctggcaatttcggaactgctgatcgcgtctttgaagcagtatgcgcagtggaggcgggacaacccggatctccaggtgacaacaacaccgtcaccaacaccttcggacgattctgaggtgtcctcctcctctctctatggttttgaatttgagcctcatagcgaccagaagcagatgacagaattggaggacctgatcgcgctggaggatctggatgacttggacgtaaagttcaatatatatacccaatcgagatcgcggcggtcaccacaatgcctgatcgagccacagttgacagaatcctccgccaccaaccttctcaatgatgatcgggatctatccagcttcaatgatgcgtccgttttgagaccggcggccagcgacctgatcgatctctctaactgggacaacatgagtgcatcgtcgtcggtattttctcagtcatcaggcggtgcgttaccatcaccgaaccctcaaagtgtgatgccgaattcccttcttattcaggaggatgaagaagacgacgacgacgaggatgaccccaatacctcctaccattcagaaagctcgatactggaagtggatcttcagcaactggacgtgacgaacacggtcctaccgcaacggcagaacgggaagaacgacactggttcggacttggccgagttgttggaaattttcgacaatcattttcgtccggaaaagcagcagcaggaccacgaagagaaggacgacgaggatgaggagcggcaggagaaaaaggaggacgggaccaacggcaatgtcttgggtgttcagagagatgggaaagagtgcgagaccgttttggaggaaactgagagcgtcgtccggctgatccagttgaaacaccaagaaaagattttggccgaaatttcgaggggcaagaatatcctgcaggtgtacgcgtcgctcgaagtcatggaaatggaacaggcgcttctacgacgggcgaaggggtttgacaacgagacctatggctcacttttatccagccgactctaccagatggggcgattccgggagtgtgctctcatctcagccaagtaccttgagcgggatctggatctggagcaggagctgctacccatcttgttggaaatggttgaccaggacacgatccatcgttatgtcgacaataacctggacgtctgttaccgagttctatcacacatcaaccaccagctttcatttcagttctactactggggtcttgtcaatccggaactgacgcggacactccagccagagttcgcagacatcccgccgattagaggcgccggaaaggcgaggacgcaagctggccttgtggaaattgccatgggtctggtgatgagattcaacatggagtcggagcaagagtcgtttgcctttttgaacctgtttgtcaagttttgcactgtgatctcgctgctagagccgtcgcagtctccatcgccatcatcgtcaccttatgcatttggatcctcgacctcaatgacctcatcggcagtatcgtcaacgatgtcgctaacggaggacagtagtggcgttacttcgaacgggacgttgaccaagtccaagaacaggagcaaagattactcactaaaggcaaactggcggttctttcatgtggttttggacatcatcagggactccgtgactctcaagcagatgaccatctatcactgtatcgggaagcgcgatcttatcacggccgagttctttgccaccaagctgggtatgatcgactactaccaggaaatgttggaccttggcagcagttcgtccattttaccgttagcctccgcctcgttggcatcgtcgactacattactctcgccaactagtgcagaaactacaggatcgaacaacgtcagtgcttggaatgtcctttatcggtcacaggtcaatggagttggcccgccgcgtgcaccagccaaagcagaagccatcaccaccagttcagtataccaactgcctcagaacgtcaagatggtctttgtggacaggatggagcagcttgagattgtgtcgtccacattatcgatgtcgaccgtggtagcaatggacacggagtggctcccccagatcaaggagtacgagaagctttccaaggggcagaggacagcggtcttgcagctggcctgcgaccaccagtcgacgatcttcattgttgacgccatcgcattcctagaggggcccgatcatggatcgaggttggtcgaggtgctctgcgagttgttttgtaatatgagcaccatcaaactaggtaagatcatttgtcaaacaattcgaggcgatctattgttgtgtagtatgcacaagtggcacagcttttgtttgtatcgtctaacagtttcagtcttctactttttgcagcgtttgactgggatggagatcaagagcttttggaggcgacatttccagcgctttacggacctcagaatcggctgcagaattttatagatctcaagtttatctggataaagaatcgcgaccgcacgggcgatgacgatcaggctcctgatggcggtcaatcctatcctgcaggtggcacggaactcgaaagctggtccttcattcaggccgtaccaggaatgcagctgactccaggtggtctttctggcttgcttaacaggatttgcggactcaagctggataaggcacaacagtgtagtaactgggaacagcggccattgaccgacaagcagtgcgagtatgcaggtaaggtgaaagaagaaaagcttgatcgaatggtctctctgcacgggcaggctcacgaacggttgttttttttaacgtcgatcctgcttaacgttttttttttgcgctcttatcactatattggaaacttctagcggcggatgtgtggtgtattctcgatatctttgcgaccttgaagactctcacactgatgtaaatgaataaagcaggaagaaacaaaagaaaaggaaagacgagtgaacaaaagaatgacatgaagccatgcttgacaagcgatagcaacagttacagcaacagcaacagctgtaccaatgacagagggaaaaaaagaaaatgcgttcagagtaagggtaccaggagcagagcatgtatgccaggtcgttgcgaattctcatttgcgctcacgcgtaactttgaaaggagtgtgatattacaacgccgagtatcattaagaactggcgggaaatttcccatcacgaactaatcttttagcccccccccctttttttttcttcatctgaactgccccgcctcgctgttcttcctgatctgggtctcgctatccatctccgccaggaccttgagccagttgctaccggcctcattgcgcatggcctcgatcttgcggcggtagccctcagcgccaccttcatccgacgacgagtcatcgtacgatgcaggtcccatcctgggtgagctcggaccggtgatgctcgaatgatcaaagcctccagaggtactctttttgaggatcccccgcgaaggttgacgctgatggcgatggtgatgctgctgcgagggcgaggatggacggtctccactgctgtcgttatcgctgttgttgcgctgatggacctgcatggtcgccatggagtgctccaggtgggagacacggtgcacatgatggctgtccttgccctcagaatggtctaccgtcagaacatggccgtccttgtgaccggcgtgtccgtgatcatcccctgcaaaactgaccggtccctgactctttttcttcttgatcaccttcttccttgtctttttatcctcgccctcgtgtgcgatggtgtcatctgccgccgtcgccgctgctgttgttgtagtagttgccggcttcttggtctttttcttcttcttggcaatttcaacaggtgagccgaggaccttggaggaatgctcgacgtcatgaggctggcgtggatccacctcttcctcgtcgtcatggtcgctgtccagattcacgacccgtttgacgcgttttgaggacttgaccagcttcttcttgaccagcttcacagtcgacgaagggttgcttccaggaggcgacgtcgcattcaggtgcccttctttctttgttgcgctctgactgttactgttggtgctgcccttggagctcggacgatgatcttcatgagactctgaggagatgcctgcgcctgagggacgggtgacgcgcggaggtggcgaggcaaggcccttggccagggtggcggtcggagccgaggctgcgggtatattggccaggttgacattattaatgctggagagcgtggtcgagaacgcggtcgggctcatgttggcgagagaacgtttttcgacaaacgacgcgaaagtgccgtccagcaggagatcgtgtccgttggccttgaatactgccaagatctcgagtcggtatcttgtctaggtaaattccaatcgaacagtagtatgaaaaaaagaaacaaagggtggttagatatcgatggttgatcgcattaaaaacaaaaagcaaggaagtaggaaaaagagagagagagagagagagagagagagagagagagagagagagagagagagagaagagagaaagagagggtggtgatggtggtgatggtggtggaggtggtttacctgcttctcacagaacgggttgctttctgcccagacttcgcgaattccaggcaaggcggccaaacgacccacctcagcggcctcgtcaagtctgttatcacgaacgtccaccttctctaggttccaaagccgttccaatccacaaagactcgtcagacgattgcctctcaaatccaaaactgcaatgttgccgagaatctgataaatggcctggacgctctccatcatattgtacgacatgttgaggctctgcaagttgtgtagatgaattaaccctgggggtggcgcgatcaagagattgtgagagagatctagactgacaatcgccagagtatgggaaaaggtatcgtggtgctgcagtgttggtagagaattgtcagagacggcgaggtgtcggagagcgggccacatcttgattgaacgcaagatcgcctgctcgtcctcgctatagctgtcagggcccaagatcggggaagtggagggcgaggatggattggagctgtcgggtgaaaaggacgccgaggacgatgatgttgaggctgaagacgatcccgaaccttgtcccaaacgcctccccttcgagatcaaggctgcgtccttgagagcttctctctgctcctggcgaatgagaacggcacggttcttctccttcgagacccgtcgccgacgtcgacgctcactctcgaccacagcagtgacaatcacgtcatggatatcctcaatgccagcttgaataatgaccaaggacttgagctgaatcattagagtttcccagccttcgatggaccttggcggaatcttgtgcagttccagatgggtcagggaggagaatgtcgatgccaagggaaggagcagttgctgtttcgaagacgatgctgcaaagtttcgcgacgaccgacccgcatcgtagatattgaggatcgcatctgcgctatatccctcaatccgccccttgccgggcacatccagacccggtgggatcttggccacgagccgaagccccgcaatatttttcaaaaacttgtggataaagtgaacatcatcctcgatagtcgctccgttattggcactggcagcgttcgaccactgcttccagcccgtgataagggtcaatgtcgagagtgctgttgaggaaaaggatcgaatggactgtgggcgcgttgatgaggccggtggcggaaacgacgaatatgtggacgagttgggcccggcatgtccggtcccgttgccactaccaccgggagaggcagccttcagtatacgaggattcgtgtcgccaacggagcgcggtgtgcttccatcccagccttcgatttcgatgccggcgagttcaaatcggtccaagaggtaaaggaggtaatagagatccagcgggaaaatgggcgccttcagctgcgcttgaagatacagctgtcgttcgcgcgggttggcgtctgcggggatagatcctgttccgtcccaggctccactaaacgagtctcgatcctgggctgttgtaggcggactttccgcggagggtgccatcgtgttcacgactgcggtgcccatggaccagagtgaattgaccatacccgagtacgcggcagccattgggtcagagggtgtcacgaatgcgcgagcaccgtgtcctacgctgccactgccactgccactgccactgccactgccactgctgttgctgttgctgttactgctgccattgtctgttgcggttgggacgagacggcgttggttgtgacggagatagtgcgatagagtgcgaacatacttgtcgccattgatgggtttgtccatccaggaagggttactccaacgaggacggaatcaaggcgagaggtagagcctgcaagcaaaagcgcgcagcgagaatgagttgggaggcagaagggctgctgctggctgctactcaagaggtgcgaatgtcctagtcgctgcagcaagcgagggaatgacgagaggtgcaagagaataacaaaaagcaaaaaaacaaaaaaaaaaggtcagtctagtgcacacacgcgccagcaggagctgctgctgttggtgggagcttgtccgtctcacactacacgatccggttgtcgcgcacgcgtttgcgctccttacccttgttctgctggatatgcgagcgtctgttgggctggatgccgcggactatggcggaggggagaggaggaatgaggaggaatgaggaggaatgaggaggaatgaggaggaatgaggaggaatgaggaggaatgaggaggagggacggaagaaagaaagagacacaatcccgaggacctcgattctcttttcttcccatgggaggttcacgactactttctatatttgtttttgttcagtcatacccaagtgctctcatcctacaaattgtgtacttcatttcactggccattccgcaccctgacccccgtccctgctatctgcccacatgggagcggacagatagacggatcctgctgcagaacgtgttctcctcagcagtcctctttctttggttcaatggacctctccagcgcccgcccattgcctcactgccttccgcctgctgtataattttattccgagagggagggaagaaagaagaaacattcgccctaagccttggtgggtctaagcatccggtctagtctgcttttttttttcttgtgttttttttatgccgtcgaggcttgctctttcatcatgcaccactgctcgactttttgaggagatggcgtctcatgcatatgcaggtcgaccactccatgcaaccaagaaagcaagaagacaagatatcgcaccatgcgcgcacgctccctccgcctgctgttgagcacttgtacgcccaccgcggcttaaggaatgaacatcgatctcagcaacacagacgtattcatacacagcttgaccataccacgcatgtttctgagctatcgtcttatctgtaaagcaagaacacacgcgtcatggcattgcaccgccaaccgagagaatattgagactagccttgtgccctggttcatcaggtcccgtcgacgttcattttacaaaagtgtcaatatcccgctcagtcccctgatgtgcccacacatcagccctagtgcagccatagcctgcctctaaaacaactcaacgtactcaatattgtcgttccagtaccctgtgagtcctgaaaagtcatcgcatcattgtgggctactacgtcctctgtgcttgcttgtcagctttcacctgcgtgctttcttccactggattgcttaggtaataactggtgccgttcggcaatctcctcgagtgtggctgttccctgttgtagaccggtttgatggcctgctttgtttagtgaggttcatcttgttaacgccgatctctgcctcccatgatcagcagagtggtagttgtccgtcaacaccacatccctgttgtgacatatacacagactcaacactcacagacttttcaatgggatcagatcaacgtttgagaatccgacccgattttgaagtacgcggaattttttttctaatgcgggactttggtgcgagcaagaaggttgtacggaccgcaacggacacgcgtgcgagttaatgaggttgcggtagagtaacgacttcaatatattttttttacattaaaagaagaatgctgtctctatagcataatatgactatatctactttgtctgatctattcaccttcttcacaaagacggcaaggacgtgttgggtttttaaataaaagcagagctgcagcaggccagacgactagtagcctgcggcgatgccgtgcttcctcgagtcactcgctgcataaatcaacccgtcggtttctctcatcaccgcttgaacttccgctttggcaaggataatgtcggagaccgttacattatggccacgtgtggaaagaaacttcacttccgagggggcataaccagactcgatatcgacaacattgggcatcaactgatggtgcactctaggtgcttcaacagcttccataacgttgtagtcgtgattgtaaatgttcagcattgtctaagtcagaaccatgaaaaaaaagcggacgttaacaaaacgatctgaaaattcgaactttgcggccacatcttccagccagtggtccaataagctcctgatcatgggacgcacctgcagcacagacgtcaagatcctggacccgccgctgccacccagggcaagttcgaatttgccatctttctccacaatcgttggaacacacgaggacaagggacgctttccaggcctggggtagttgtacggcgagggttggagtccaaatgcgtttggcgttcccgggatagaaaagtcatccatctcatcgttcaaaataacaccggtcttgggatccaaaagctttgaaccaaagaccagattcacagttgaggtcaaggccactgccatgtcgttctggtccacagtggacatgtgtgtggtaccgtggttttcaattgggccccagtgggggttgtagtattccaccgggaaggtatgagcatccgagatgttagcccgaataagacctgcagtgtcctttgacatgatgctctggatcttggcctccaggtcagtgtagtctgggtctcccaactctgttctttgagcatagccaactagtgcgtatgaaaaagaatgtgttattaattagcttgggcgcacaatacaacacgaaaaaagcaaccaagccgatccttacatttcattgcttcaaccaaacgatgcgcttcaacattagcattttccttctctctaccaaggtcatagcgttccagaatgttgagaaggctgatcaagataggtccgcttgttggcgctggagtggtatagatctttcgaccttggtaatatccaaccatgggctccttgatcaagggcttataacccttcatatcgttcatggtcagaattcctccattggtctggatatggtcaaccatgttctgagcaatgggtcccgtatagaaagcgtcagcgccctccagtccgatcgtctccagagtgttcgccagcgcctctcgcttgatccactggccttcccttaggacggtaccatttggcgcgaaaactgcggaccagtctggctctgattccatcagcaccttgtaaacctgcagacgctttgcgagctcaggtccgatcgcccacccctctctcgccatcttgacagagggcgcaaataatctttcccagggcaacttgccataccggctatgagccagctccaaaccacggatttcgcctggaacgccaacagacaggccaccggtctgagcaaggattgggtgctccttgaacatcttggggcttgctccagcaggcgctgtctctctgaaatcgatcacctcgaccgtgccattaggcagtcggatggtcatgaagcctccaccaccaattccggctgagaacatgttgacggttccgatgcaaaggcacgacgcaatggcggcatccactgcgtttccgccatccttcaagactatgatatcaaaaagtagataaatttttgtaagacaacctgacagatattgcgcaatttcacacggtagcacataccgttcctttttttttttttgctgcgtaccttggacaccaatctccgaacaatgaatctcctctgttgcgacagcaccgtgcttagccttgatcaggctcggggtattcttttcgatgcctacaggtgcaggtacataagcgattgcagagaaggacgaaggataaccaataaaaaaaaaaagtcagtggccggcaaggagcagttgggaatcgacccacctgccttcagcgagaatagtacagcaggccaagatgcaaaaaacaaaaggttgagatttactaggagcagcgccaatctttctgacaagcgcaatagccaggaccacgagtaaaagggcagagatggacgtcagcgcgacgatgatctttttccgtgcatcgcttgataatgctcgcttcgcaggccgttgcttgttgctgttggaatggccgctgttctgagaagcgcggcgctggtcgccgagaagagaggttgtttcttgggccgggttgctctcgctgtggtccggcgaaggacggccgtgacccagttcggcagacgagagctgatcggatcgagggttgtggttactagccatgctgtgtgtgctgtgtgaagaggggggggggaggggggtatgtgagctgacgagcaggcgcagtgcacagcagggcctgttggttgcaagcggaggtcgaggggcgagggcactggaggaatgagggacagaaacgaggaatggagcagggcaccggaaatgtgaaataatgtggaggtgcgggaatggagtgcgctgagcgagcgaatgaaagaatgctcgttgcccccttattgccaaaggacggtaaccaggagctgaaaccagtggaagtggaagcaagagaggcacgcggaaagaatgcaacagagagaaggagcgagcgagaggggcggcaaaacgggaggtgagggaggtgagagtggtgagagtggtgaaggagaacagacggtcgaaacggaccagcgtggtgcctcttgcttgccatttatgggcctcaaaagacgatttgtcaggcacagccagtcagcaacgtccataccactacgcagttggtgtgtcctcaggacaaaaactacagcaacagcggcgcgtgctgcttctttctaaactgcagcacaagcctcacaatctcttgcggacgcctcgtagagtatgtgctatggcgctacggtgtccactgtcctttgaggagcatagacagccatgcgtcaagccagtcaacagttgactaccgccagactctattcagtattccagctcatggaggacgttaacaccaccaaatttcatacttcacgccatatcgatgcacttagtccaaggtacaatggcatttcatgatctagaaacggtgatcttcaggcaccagcaagcatgcacttcttttgtttttttttttttttgttatttatttctaacaattagggaagtatggtacagttgggggagggtagggcgtcaacaggcgatcctctccaagaaagagaaaagatctgatgtctcagcgcactgcaatcgttttcatcactccatgctttagtacttggtcagagcatactcagcctgcttggcaagacgagcggcctcgttgatggaaggacgaagcttgcgggggacgtagtaatacgaggtcaagcagtaaaagaagaaaccaaagagaccaatgccagagtaggcccaacccttggtgcctgaggaaagctgggcatcagcaaagatgggctcgaagatcatgatcagaatcgatcccagggaggtcgagagcaaccagaacgaggtcgacaccgcacggaactggcgaccggcctcaatgtacgtgaactggacacccgtgggcgagcagagagcctcaccgagggtcaagacgaaccactgaggaagttgcaaccaagcagagtagcactccgcgcagtaggttccatcgtattcctcagccttgatgatatcgcggccagacttcatgaaggcatcctcgatcataggggcaagaccggcagagatggcaaaggacaagacgatgaagaagaaaccggcggccatacgacgctggggagagaagttccagccgcggcggtggcagtaggggtagacccaggtggccaaaatgggcaacaagaccagaatgaagatggtgttgatgatgctgaactgggcagactgaacataggaatgggttgggtcggaaccaccaaagatggcaccgttcatgaggtagtactggttggaccactcgttggagttctggttatacaacatccagcagaaagcgaaggggatgacgacgggaacgaggacaagaccgaaatcgcggcactcctcaacaaagacaccaccgtacttctcctcggcaaagttgagccagtggcccttggcagcacgctcagcaggggtagcagcggagtgggccctagcagcatggatggtggcacggatagccttgaggggcaaaaactcgcccagtggggggacgatacggtagaaacggtgaccggcagcaaagatggccaaggcgagcgcaaagacgacggtggggagcaagaaggcaccagcgtagcaagtgtcctggccatagcacttcagcttggtcaactcaggcacaatgaactgggtcaagaaacctccgacgttaatggcaatgtagaagatgttgaagaagaagtccttgccagcctcctgggaagggaggtattgatcaccaccgtgggacgagacgcagggcttgataccaccggtaccgatggcaatgatcaacatgggcaagaaggtcaagaagttggagacggtaccagttggtccgaggagattggggatggcgaaaacagtaaccatgatcataccgatcaagtagatgaccgagaacgaaatgatggtccacctattttttgttcaaaaaaaaggagacgcagtgaacatcagcacctcagtacgtgtttaaacacacgatgcgacacttataaagcgacgaatagacctcattcaaagcgctaaccatttgccaaggaaagagtcggagagagcagcaccgatcaaagggaagaagtaggccaacatggtgaaggccgtggagtaaaccttggccgagaccgcgtccattcccgagatgagacggaagtacttgttcaggttgggctggacaccgtagtagcagaaacgctcaccaaactcgttgggcaagatgaagtagacagccttgggcatcttgttggggttggctaaaatcttggcatccaactcagcgttgaggcgagcctccaactcaagcagctctttctcatggtcagtgagaaggtcaagaggctcaacctcgagttttccgacgccgatgtcgccggcttcgatatcgcgcttttcagacatggtgtgagtgtcgaaatgggatgtgaagagggtcaagaagacttgattgagagggtatcaggtctttcaagagtgtctggaacagaggtccgacgtgggtgtgaaagggggagcgggcgagggggaggaaggagtttgcactagaggaccagaatgaaggtgggaagagcggacacttttataacctcgtcttcctggcacgagtagaaggggacttgcgcgcttctttacaactgagtgaatatatcgatcatgtccagggaacaactgattgcgcgagcgaaatcaattggtacggtttgattcaataaggagaacgggcaaagtcagtcttcccacacaccaagcacacgcgcgcaatttcagtctagtgaaaaaaaagaatagactgcaatagaacgagtagagccatactttgttgtgtttgggcaaattgtgtggtaacatttgcttgcgtgcgggatgaagtccgagtgtggtacgacgttgcgtgcaagtgagcgatgtgagtggtcagcgacttggtgctcgcaagtggtgtttaaggttttccccttagacaggttggctttgccttgcgccgctactctaagcaaacaaagtaagacgttcatgtccctatccttcttgctgttcttcgaatggcggatagggttcaaaattatcatgaaggccacagctcgtgacatggcgataccggcagccaacctgctcgagttccgtcctgacaataactctccttcctgcgacgaccattcgaggtctcacgcaaaaacctgaacggcaacttatccgtgaatgcggaacagaccgttgcccacagtccagcacgccctcaatccgtaatggcgcaaggccatcctgctttgacgctgaaggtatggagggggcgtacaaaaaaggtacttcagtgatagtacaattttgcatccgagttgcccagttagccaccactacagccctgtagacgctgtcaagctcgaagctgtttcgatcctcacgcatttctcaaaccgtcgaagaaaactgttgcagaatatggtgttatattgcaagatgctagtcgtagcctaggctgtccacgctttttcatttgcatattgacacagaaacccctccattgtccaaggcagatcttatggcaccaaagtggtgtataaaccatcgtagtagctaccgagcgtccccaatccacggagcaaaaacgaaggacaaacaaacgctagaagatactgtttatgtacacaagaagcaccgcccgtggattgaacacacgcttggcttagtatttcccatagttgtttactggtaacctttaagtgatccatgcagccgtcgtcaacacatctttttagcctctgacatttcgagggcgtgctcttatggtgcttttgggttgcatgcttggtatctacctggctgaataaagactggatcaatcaaaaggaatggtcgtctgaagattgagttgaccacgatgctatagcagcggaggggaaaagaatcataaaccagattttctttgctgaatgtccagagaaagcctattcccttgatttcgtgaagcgtgcagctggtcagccgcccaatcagaacggcttgagcaccgagaagaaaccccaactcaaatacggacttgagtgtatatgtaacgtttaccggccagcctcacccaaagatcgccaaggcctatccttctatcaagcccaagcttgcagtggactgtgtaccataggggacgagccattagatgcggagggtatgcgaagtgtgaatcaaggagctcgaaagatattaacatgaagtgcgctggttgttaggcagcacccttacctctacgccttcttcacctcatgatctcaattcctctctgctgtcgaaaattgaatacaaaacgacaaattcgactgagatgcctgtcatcgcgttcagtcccagagaacagtttgggagcgattgaaaagttgctgggcgagccaaacggccaaatgcgtattacatgaataacaacaaagctgtctgtcgatgcatgtgtgcgttgtacggtcgctcactaggcatgttgatgcgctggagcgtgtgatagtgcagctctcgccataattggatgaagcttcttcgcgggcagagtagtgggtggcctttgcattttgattagaatcttcaaggagttctttctcagcctcacctgtcatctttctcctttatcaatccttataaatgctttatattatcggtgatagcggccgacctccccgcgcattctgacgacgcttctcaactttgaacagcttagccgacgtattaccgaaatgcgtctcgctcaaaaccgtcgagtttcaaccaatgcattttttcacagccagcaacaggaaaaagaaacgtatgatgagtgagtgcagcactcgggttacattttggcacatgagtcggcgcacgatcagactcgattatcaggacgcaatctgacgagagacaccatcaactgaattgtggattcccgttctcttcggagcttcgcaagagatttattcaattctcaaactgcaaaaaatatttaacgggaggtgttggcgatggcgaccttggcacccttggcgccctgcttggagaacttgggctggccacgggcagcagaggtggcgctctataaagtgatttaaacaagaacaggttggcgtcacgttaatacgagtcaagcaagaagaggtacatgatccgaggcagagacaacaggcgacgattgcggagcaaaacgcaccttggccttctcagccttcttcttggcatcctcctgcttcttcttgtccttgccatcgcggagagcggcggcacgggcagcagcacggacctcgggcttctggttgcgcttggcgcggatggcctcccaggaagcaccgacgacagcacgctggtgcttgacagtgcggcgggtgcgcttcttggcaacctcctcagagatacccttcttgtgcatgcgacggaagagaacggtccaggagatcttgcgggggttcttgcgctgcaagaagagggactcggccttaccgttgacgaaacggaacgactatcatgtggcacaagcacgagcagcgaggtcgttagtccactgtgctgatagtcttctctcacaacgactgtgtcgctctaacaactgtgtcgctctaacaacgaatctttgacatccagtggtcccagggttcatagcgctgatcgcgacctttgctggcccacatcatctcacgtcgtccatagccccaaaagcgatcctgaggcacgaacaaacgttctccaaagcaaaaatgaagtgtagccaagagacttttgtgaaactgaacgtaccctgttgtcgacacggacgtagatcttgcccttgccggggtagatcttggctccagaaaaggcgcaaatctcaatcctgatggtgaaaaagtaagagaaagcgagaaaagggtcagaatgacgatcgcaaaagacgcttttcatttctagggctttcaaggggatgctgtccatgagatccaggtgaatcctgtgcaagttcaagatcgtagtgctgttggaacaggtgcgcccatagattttccgattgactcgtactccaggcaccgtcatggcgcctagtgtccgcatcgttgttgcgctcgcttaggctgggttgaactagcaggctgttggcagcgcaaggggtgaattgtaattgctgtgcaggatcaaagctctccctggaaatgcagtcgatggagctccatgggctccggttgcccaagaacacttcgactgccgttgcaggtcacgataagcatccttgggactaggcccactcgtgggtgtcggttctgtctgtgtggtgcatctgctctgctgcgtgctgcatcgccctttcctgcccgtccttgctggactgttcagcctgctgatgcaagagacgatccggcggtgctccctgtctccgcgcaaggtggattgtgcgcccccatgcctccagtgcattgtgttgagtgagctggcgggtgtgcggtggatcgatggcggcagggtgtcgatggatggatgcgatgggtgtgatcgcacggatgggctgccccacggtcattacttcattttgggtctgagttaaacgaaaggaggagcaaaagcaggcacggcggcaggcgcctatatcgaaattttggtggctgacgggcgcgctgatctgcatctgcctctgctggtaccacagacgcacgatccgcacactcctctgctgcctgctcgcagcgacgcgtgaggagcaaccggccgatcactctcgtagccaagtgccgacaggcagctccccatggctgtacaggcatagcgcatctgatcttcttcggctcttgcggtcagagttgcggcttgtctaacacctggcacccagtccgatgcagctcgcggctgccagcagcgcctccatgcgtcgaatatgacactttttcgccctgcgtcgccttcgttcgaagggagaagcagcggttgtagcaagggcgggttgacggggcgctggaggcgccgttggttgcatagtgagtcagcgcacaaggagccgcagtcgcgatgcgcgcatcaccgtatatagtgtgggagctgtgcaggttgctttctgagagtgtcactatttttgcgacacaatctgaatgattgaccgaatgcacctcaccaccgtcaagtcccatctgcagcatcgacccccttccttaccgtccataccccgtctacggcctgtgccatcgtccgtctgcaccgtctgcatccgccgacaggaccgcctttagagtttttctttctccactcgttgatcttgtctcttggtggtgcgcattcgccttttgctcaacccatcaaacggatggccgcttttcaattgcccgccagtccgctggagcaatcgccctggatcaaccaccagggctcactgccaccagaaatcgacattgaaggcaacattgagtacaaggtacaatggacctctcgaagccggcttggcctgtgttccgtcgactccgcccagctcagcccagacgatatgtactgcttttacctgcgcttctccgctgctctgcggttttgacacgaagctgaagtctctcttctcgcctaccgctagctcaagctaattgccactgcccctgatcgattcgagcacttggtcacgcagttgaagtggaggcaagcactctttgaaagagaatttcgtgcatcgactgtccaacgtgtctgcggtagggtccctctaacctatctcccccctttttttccctcatgtccttgccccatgtgcattcaaccaactctcagactatccgagggccatgggagcgctctttatgagatcggcgttgcagacgacggctcctttgtcggattatcgcccgaagacatggagatctccttgcaaacattgcatcggatggccgagtttttgaaggccgatgtgaccattctgcgcagagtctctgtcgagtcgacccagcccgaggatggatcagcgccaggaaccgctcgaaagcagccttcgacccatatcagtataccccgaacagatccagagtacttggtggtggaggccaaggtgacttcacgcctggcggatgaacaccacttcatggagatcagagttgccctggtcggcggacctgacgctggaaagtccaccctgctggggcgactagcacatggcatcgccgacaatggcagaggaaaagcacgtatgtatcgacattgcgctcgccagcgcggtgtgcatccgtcattgcagctcccactgacgtcaacttgttgatataggtttgaatttgctccgacatcgccatgagatcagcaccggcaggacttcgtccatctcccacgaaatcataggcttcaccgcaaagggcgagaccgtcaattacaacactaccaacatctcaagttggcaggaggtgtgtgagtcatccgcgaaggtcgttactcttttagatacatgtgggcatccacggttcctcaagaccaccatctctggactcaccggacactcgccggactatgcttgcttggtggtggattcgagagtcggtggagtcagcgagatgacccgggagcatctggcgttggctgtggcattaggactgccgacctttgtcgtagtgaccaaaatggatgtggcgactcgagagcaactgcgatcaactgctacagcactgatggccttgatccgtacaaccggaccatcgtgcctcccatccgtcgacattgaaacaggattctcttcaactctattgtcatcgtcaacctcaaaatcttcctctactggaactatcgatagtcgggttcaaaagtttgttccgatcatcgtccacaaggaaaatgatctggaagctgtcgttgaccggttttctaatgcacagactatcgacagaaccaacagcgtcgctatccctattcttctgctctccagcgttactggagagaacgtcaacttgctcgagaagatgttgcggctgcttccaaagccgagtctggatgaccatggtggatcgtattcgcaagaaccagcttgttaccaaatcgaggaaatttacaacattccaggtgtgtgcagtcgctctttctctaaatttgatatgcagactagaaccgctctttgaaatggtgtgggactaactaaagcactctctgttctatatagacattggcactgtcgtgggcggttttttgcactctggacggattcagatccacaaaaacggcactgtctccaaagacactagcacaagttccacagggacgcctgtgccttcagcgggtattccacaggggaaggcgcggaatcctggcaaaaaaaacatgcgactctaccttgggccagtggaccgggatggtagctttatacctgttgtggtaaagtcaatacaccgtcaacgtatgtccatgcggtccattgattccggacaaacagcgacactggcgatagaaggtccaggattaggtcgagtcaaggttcggaggggcatggtcgtgctggaaagtgacacggatccgagaggtacctgctgccagacctttgaggcgattatacaagtacttgcgcacgagggtgcctttggcgtcggatatcaggggatgattcactgcggatccgtgcaccaaaacgccaaggttatcaaaatcgatctgcttccgagttccgaccaagaggaagacctctcgcttagcctggacagcaatgacgctgagctcgtatcaacagacagcggcggtggcatcatgggagagcgctcagcaacggtgcagagatcggctagtagggcgagcaaatgtgacagtgtccgtagcgctcgatccagctcggtcagctcggagtatgaatcaggaacaggttcttcaattacgggctcggtagcactctcgaggtccaactcttcccgtcgcgctgatactgctgccttttttgatgatgacaatgaccacaactcttcaatatcggaaaatcagcaaccacaccagcagcgacggcaccgtcaacagaatgacgccggccatgcgggtcaccaggagcatggaatgatacccatcagcaccatgcggaactttagaaggttatctttcaatcgtgcaggaggatcgagagaggcgacctgtgacagtgggggtgtagacgctgtggatgagcgacacgagctagctacagccgatcaggagcaggacgtggagttgcgttcaggcagccgcgcaagaatagtgttccaattttgccacgaggttgtctttatgcgtgaaggcaccacggtgctgttccgggacggcggaaccaagtgcgtaggaaaagtaatacgaatgctttgaggactgcaaggctttccttttatgcatttctccccgtgcactaccgtgagagaatttacatcaaaggtcatacgtgtgtgtcctacgactcaaatataaactggagtttcgcacgatctttgattgtgtgtgcttacttatgaacatgtacttgatgaacaagcttctttgctttgtcgacaactgacgccaggaccgatattatacggagcctttaggtaaaccttcggaacaactctgaatcaagtatagggacagctcttactttgtctggcaccggaatactgtacgatgggccttttaaccaatcccgcgattctctccctcagaatcagaagtaagttgattttgaagctcagagcgtgtactgtggactactggggcgatgtaggtctgtggtctagcttccctcattctgtggcctgttctcaacaaagctgcggtacgacttctacaagtctcagctgctgtggttatcgagacacagagggaacagcatgtttggacagcatgacccaaaggagaaggtgtttatccgacttatcgcagagtaactccccctcatcgtaaccaacgcaatgtaaacgagaagacttgctggcctttgagtttagcagctcaacgtgtagcagtctagtctttctttcggaaaattttccgcgtgatgtctttcatgaatgttctcacagtctaggggactctatgaatagtagtctatagaatcacagattcatccactcaaacaggcaccacaaattgacgcgaacagaagcaccagtgaggggagcattgtagttgatatcaatgaacacggtgaagaacaatccatgtttacgcatagttttgccgctaaacttctaacgattagactattttatgaatattctcacgcatggcggacggcgggctgaggcagcaaaagtctttgttttgaaggaaacgaacgtctgccttaagaatgccaagatgtctctgggcaatgcacgacgtgcgtctagaacacaaaaccttggatggggctttttttttttttcctgtcacccgtcaatcataaaattctccttagttcatttcacggcagggcgttgagagccaaggacgagagggtgggatagacctcacgtttatctcactgtcaaagcacaccattagaaccaaagaacgagcaatgaattcgctgtgaaccatagaagcatcgttggaattcaagaagacgttttagtagcccagctttggcccccttccatgtccaccgtgcatttcctttaatccatcccgtacactatcgcacatctgaccctacagcagaacatgaaaatagaagaacacaaaaagtcgctgggataattttgaaagtcagtctatccaggtacagcctgcagacacgagctgcccagaggtacgtggttactgcgtgtggcagaggagaaagcgagagagcgcaagattctattgcacgcaattctctctgccaggcacccacggtcaatggtgtgatgaagtgcactctcgtgttacccaatagcagtggtttgtttaccttcaggccaatggacgacatttggccgttttgccatcaagacaagcttgcgacgttatttgtttatttgtgtgctcaaccgcgtggatgccaacgatcgattgagtaggaatacttcgtaatttacgtttacacgggtcaagtgtgctcaataaggttgttttggtacactggtgcagcgtaaaccattttcagggctcacccgtccgctcgcatcggtggactgcaggatagtggttcattgccctagctccgtaactttgttctagtcgtctgggtcttgggcttgggcttgtcggaattttggggaaaaaaagtggaagctcaattttccgcaagtttctcacatcacgcgcagaggaggctgctgctcggatgcttaccggtaggtgcatcttcagcttagtgctgcaactaaaggcgtttggccctccgttacccaactacaatgaaccagagtggtcctctgtggcacccgagaaggcttctgttgcatgaatatcgtctagcgcgctaaaaatccacatctgcatcgcccctgtgcttcccgtgcttaaacacgcgcacacccaggcattctttcatatttgtagacttttttttctctctttacttctctttgttcttgcgccagtgtcattcagctcatcttgttccctcggcctcggattacggtaccgctactcagaatgcagcaacaaaacagaaataaaggacgccacgactattatgagacaggaggcgtacaatatacctctatcgctggaagctcttgatcgacaactagacgagatagtccggcgaatagcaactttaagtgcacacgaacatcttcgataaccctcagcagacagtcttaacagatgtctacaagccttgttcttgacaaaactaacaaccattttggcttagaaatataatgacaagtgagaacactgcgatcaaggaggaaaagcaaaaatggccgatgagtgcaggggaaccatgtagtgacgagcctcttgcgctcttcaatgtcctatgcccaacccctctccagccttgttcaccctttggttcgaacgtggttcacacaaaattcttgaaaacttcacaggaaggcaaattttctcacaacccgcggatgaacgaccacaacaatgaaaaagtggataaatagagtatggccggtaggtacccacgcctccttgttgttgtctctggggaaggggggggggttgacacttgggccgcgttgcacagaaaacgaacgccaataaacaaagcacaaaaaacaaaaaattcatcgcaccagctactgtgggaaggatcactctctactagacaatatacatgtacaacagcggctgatcgcctcatgcactttgcgtgcgtatttttcctacaagacgaaagaaggcgatgttgtatactcccaatgcgcgcgtagttcgcgttgtcagaacagacaggaagcctctcgttttccaaccaggaggtacatatgacgccctgtgttttctttgttgaggaaaaattggctaatgcaacaccaagggcttcactgagaccttggctatacgacagataatctatcaagcaagcaaatgacattgcgcagaccaccccaactttcaacattcgtcaagtatgacggtgtgtaaggttgcaagatattatggtttaatgccaagagcatatcttgaccttgtgaggcgcatatttgcgagagaagagctgaaaaggcgagaggcgtggacgacgagagcagggcgaaaatagatcataaattctcctatcaggtagctgtgttttgggtctcgtatgccctcttcccgaaagcaaagcgtaggggcagggtctctacctgctcagagagacctaaggcaagaacgcagggccgaggattgtcagagggcacagatcggctcagtcagtttcttatgatgatgatctcggagacgaggagaaggcggtatctggccatgagtacaaaatttttcatttccctcgcacagagggttattaatcgatcgagatcgttcttggattatggcatcagatttttttgtcctctcggagggttgttggagttggttagaagcaccacgctttacgatgatcgtggcaatcacttggttagagaacggccttctattgtgcggatgccacccttgcactatagcgatctcctccaggaccacgtccgagcgctggaggaccagaaatgggactttaaaccccggctcgtgtaccatgtgcaccattttcattgcaacattacaccagcagtacagtgacataatcttctgtgcaactcgtccactcgcatcaaccccgaacggaaatattgcaaatgacaaccaacggttgatcagcgaatcgtgcttccggtcccagcagagttagcttcttaaaagatgccgcctctccaagacaacgcttcctcctcaacctctttaaaagtgccttccgagagcgtccaaaggagaacggtgagtggttgaaagcaagtaggtgtgcacgtcttggacaggtacccctctggctgacccttctaaactttcgcaaaacatccctattggatatctaaaccggcaagccaatcgtcgcctacaggatccagattcataatataccttattttgaacactccggtcctattcgattacaggacagcaagaaaaaagactgatcgagacctatgccctccattcgttcagcacttctctcaagagctgccagggcatccgcacgcaaacctgtaaacccccacgacgctgaccaccagccccccttgaatgtcatcattgtataaaagagccggctacttttccacatttgttttttttctcttttttgttttgatgttggttccctagtgcaaactccttccctccagtcgctcaactccttattctccgtctcggatccaccctcatcctcacccttcctgaagacaatacccctagccgccgcactctccccacccacctaccacccatcatgtctgaaaagtacgacattgacgctacggagatcgacctctctgaggagaagggcgtcaccgctatggatcttctcaccgaccatgagaaggagcttctcgagttggaggctcgccttaacgctgagctggatgccaagatcctggccaaccccaacaagatccccaaggctgtctacttcatcttgcccaacgagtttggtgagcgtttctgctactatggtgtccagcccaacttgaacaagtacttccgtctcatcacgggtatgaacgcggtctcggctaaggtttactccacggccttcaccatgttggcctacttcttccctttgatcggtgctgccctctccgactctttcctcggcaaatggtaagaacggcacttaatttttgacgcacgcacacaacctgcctttcctctcactactgctctgagctcctgcgtaatcactgtctaaccgtccatgcatgtaaatcttattgacgtttaggtggaccatcatttcgttctcgatcatttacttgatcggtatgattatggtcactgtcttcgccattcccggtctccttggagctgctggtaccgtctccaacttcgtgaccttcttgcccatgttgatcattgccatcggtaccggtggtatcaagccctgcgtctcgtctcacggtggtgatcagtacctcccttcccaggaggctggcaaggacttcttcttcaacatcttctacgtcgccattaacgtcggaggtttcttgacccagttcattgtccccgagttgaccaagctgtcgtgctatggccaggacacttgcttcgctggtgccttcttgctccccactgtcgtctttgcgctcgccttggccatctttgctgccggtcaccgcttctaccgtatcgtccccccactgggcgagttcttgcccctcaaggccatcaaggctaccattctcgccgcccgccgccacgctgctgcctcccctgccgagcgtgctgccaagggtcactggctcaactttgccgaggccgagtatggtggtgtcttccttgaggagtgccgcgatttcggtcttgtcctcgttcccgtcgtcatccccttcgctttctgctggatgttgtacaaccagaactccaacgagtggtccaaccagtactacctcatgaacggtgccatctttggtggttccgacccaaccaagtcctacattcagtctgcccagttcggtgtcatcaacaccatcctcattatcctcctcgttcccttcctggcctcggtcgtctaccccttctgcaatcgccgtggctggaacttctctccccagcgtcgtatggccgccggtttcttctttgtcgtcttgtcctttgccatctctgccggtcttgctcccatgatcgaggatgccttcaagagctctggccgtgatatcgaccaggccgacaagtacgacggtacctactgcaaggagtgctactctgcttggttgcagttccctcagtggttcgtcctctccctcggtgaggccctgttctcgcccacgggtgtccagttcacgtacattgaggccggtcgccagttccgtgcggtctcgacctccttctggctcttgtcgagctccttgggatccattctgatcatgatcctcgagcccgtctttgctgatgccggtttgtcctcaggcgtcaagggttgggcctactctggcattggtctctttggtttcttcctttactgcttggcctcgtactactacgtcccccgcaagcttcgtccttccatcagtgaggccgctcgtgttgccaaggaggccgagtttgctttgatcaagtactaaagcatagagcactttgtacaatacatatcccccctttccaatctaataaacaaagacaaaccaaaaaaaagaaaagttcacaagtctagtgtacagttggtgtgtattgtgaagcacacaaaaaaagcaagcgaggaagtatgaattaagtaaactggtactatggtgcgtctgctgggggacgtgccgatcccgaggacgaagttgagctagaggagggacatgaggctaggggcaacgtatctgacgggtgtgtaagttttttccaataatgagcgatcacagctggcagcatatggtaggacgatggatcttcgagaaccggacttgcagtaaaagtggatgctggacttgaggacatgtccaccgagttcatgaaagtaaacgactgactgtcatagtcgccaatagagctgccgcttaagtgactgctgtcaagcgcctgggcaagtgggtgcacgcgctcgcgcaggtcgtctgccgccaacaacgttgcatccgcctcggctcctccgtggccatacagcgagtaccagtcaatgccagcgcccgaatccttatcctccttgccttcttcgtcttccgagtgatctctgtcctggggtggatactgagtgtagcctctgtaaaaaccgtattcgtcgcagtaccgatcgttgtcgctttcgtccatagagctcgagttgtgcccgtcatcgctacagtggtcatcatcgccgccttcttcatcatcctcgtccttatcctgctcttcctcctcctcctcctcctcctcctcctcatcgtcgtcgtcttcgccatcgtcatcgtcatcgtcgacttcgtcatcatcttcttcgtcctcttcattttcttcatcctcatcagatagttgcctacgttccttttcagcctcttctcgaatcagttccaacaccagcgggtccgtcaatgccggtttagtaagatcttcgctgccatccagtcactcgagcagctgctgagcgttcttgagaagaacttgcttgcgcagatccttggccttttttcgtttctttctcctaggggtactagtatgatattgagcgcaattaaaaaaaaattataatcataacggcacaagtgagaccaaacagactaacgcacaaaattttttcacacagcccaacgcatgaggcgagtaggcccacccctccagttcaatccaataatccagtccagtccaaacaaaagagagagagaaaacttacggcggtgcttgtgaaccgctcaaggatttacgtcgcttgtctgcgtgtcgttccaatcggcgtcgtcttgcctcttgctccagagcctcacgatccgagagcggttcgatggccggagtgggcgctgcgggtaacaaccctccatgctcgctcatatcgcgtcgacccccatagtaatcaaaatggacccgttgttgccgagcatatttgccgttggaacctggcgaatcgttttcttgcgtatcatgtgcgccacctgagtaataagcacctccagtgcttccaccaccaccaccaccaccgccgccgcccccttgcatgtcatcatcttcgtctccataatcatcgtcgtcgtcgtccgaggaagagggtgacagagacgaacatgaagcgagagatccagaactcagagaggacgacgacgaggaggacatgtatccatcattggaaggatcgtcctcctgatcgtcgtcgtatccgtaatcctgcccgtggtgtgcgcggccacctccattgctgcctcgagaatgagagcggtgtgcctgtggttgtgcattggcggcctccagggccgacgacccaaactgattccattgctccataggctcatcgcgagcgtgggaagtcgaggcgatagcagagaagagagccgagggtgaggagggtgaggcggctagatagcgagggtcggtctaggcgtcgagaacagagacgatggcgggaactgtttcagtcatggttaaaggtatattggacgggcacgagggaaaaagagaggtgggagaaagacagccaaggaaaaaaatgggacaagatagcgtgccgagcgaaacgtctattcagagccgtgcatccagcgctttcgtttacctcagactgtggagaccgatgcatgcggctgctggtgtccgcaagaccgcgccgatagcggtcctttattccaaagtcgagtctgaaaagcttcatggttgagttgctgctgtggtcaggcgcctggttgggcctacagctgtgccagaggtggtagcagtgctgttgttgactcgcggtgtactgtgtgtggatgctgttgatgggaagacgtgcgcaagaagacggggccgttgtgcagagggaggccgaggctatgcactcatgtgtgaagaagtgtgggtgcggggcggggtggcgatgagagaacgggtgggcgtggaatttgtcgtttttgtgatttttggcgggaaaatggaaaggagcgaaaggactgaaaaaaaagggccgattgtgagacagatggccacttatatccagcgcaagaaaacaatgcgtgcaatctcattcgtccagccaacgcaggaatttaacgggaagggacaaaaatattattcaaagactcgcgaggcggtggaggagtcatcagatcgtgctcttgcccttgctcgtgcccttgcacttgctcttcggatcagccggcctgttgcaactgcagcagttattaatacagtaaaagcaagtcttgcagatctcttgctcttcttgtggcagttggcacatgcatagcgtactgtttttgcatttattgtgcttttcatttaaaaatgaacgcgagaaaaattattagtctgggttcgaagctgtccgacacgaccacttcagactacctaccataaacctcctgctggaggagccacccttgcatcgtgcatggatgtgggtggcagggggcttctcaggattcctgaggttttggtgggtagtcgtttttggtcatgaagaacgacaaaactccaggccttgcggtctcaactatcacaatgatgacgaggcgattagacacggtgtaccgttgctattataataagtcttcgcatatagactagatcatagcacattccataccctgtggcgaggctgtccttgaggacgtggcgacgaggtcggcggggactaagtaggaaaagagggtgatcagacaggctggagctgaaaggggaaggggcgaggaggtcctggtagtggaaaggagcacatacctctggatgtcgctggtggaggagagagcaaaggcaatgagaaagcgcatcccaaagtgaggttacctttataccactgccagttgtcatcgctacatcatgcatacgtcgcattgatagaagcatgatctcggcttcagccatgatgatcaatgatgatggcaacatgtatgccgcgaaataactcgcggatttaatttccttttgttcaaaaatttatgaactggacaataatttttccctacttcaccatgaagaagcaaacgccgttctttgctctatccacggcttgttccagggccttttgatcttcgtccaagaattgatcttccttggggatcgcgctcagattcaaagtattgtacagtttttgaaagtgcttttgacgtgcctgcatccttgagacctctcggtggtcgccttgtccactcgtcacaagcaaagcggtgttgaggggaagagactccacgatcgccgcaatgttcctgtcaacgctctgaatagcttcccggatttcttcctctgccgcctgcaccttgtcagcgctcgagatccgagtgaatggctggttgggctcagcagtggactgctcagtctcgttaactcccacagtcgcaattttgccatggttgatctccatatcccgaaggcgcgcccacacaaagtcgtggtccgatagtgctccagaaatggcctcgaccacctcagcgtcgttcgctggcttcaggactgtcgttgcatgctccccagagtggctattcacgtcaatgaaggctgatgtcctcggcttggtgtgtcgatagagtctcgaaaagatggattcttgctcctgattatattcaccaaatcctggtcccttctcaattttcagcttcaccagctccatgcaggtgcgagcgtcctcttcagagtcgtggcccaactctccacctgtctgaatctttttcgaaagccacttttgagcaagccattttagcgacggccgaaatggcggtccacgcgtgtgatgatagaccatggccgtgtcgatgatgaacggatgagcatactatcgtgcatgattcattaaaaacgtgcaggacaaggttcaatctccaatgtcatggataaggtgcactatcaacagattgatgcataatcgctgtcttaccttcaagaccttcatgtcattttcaagggagtgaccgactagaatggtgtcgtacgtaaccagttcctgcagctttctctggacatctgccaatcttgtggtgacaccttccaaacgctctgccgtcattcctgagtattgtgtcagatagtcgacaatgggattgtctggcatcaccagctgatcgtagatggccttgccctcctcatcaactagtgtcactcgtgtcagttctgatcctacagtagtccgaaccttggtagcgacaagcagatgcacatgtcagctggagctaagggaacaaggtcttatcattcgagaacagcagtggaaagagcacgtaccatttcacagtccatggcgatcatctttttggcaacaggaggatcggtcaacttcaactgctttgtctcaatccagtccggttgaagttctgcgttcgaatcaagatagcttggtaatgggtaatccgcttcccgcaaatcgtgggcacggatcaagtagtattctgccgttaggttttgagcatcctgactctctacaaagcgagattgataagtgtttacaggttactgaaagcgtctcatcggaaaacagcaactatgtctttagcagtcaatgtggaaatgagccatacttttcttgagttccttgtcccgttttagcttctcagtgttgctcaatgggacattgaggagcgtgttgggcggtgagtgaaccctgaatttgtctcctccagctttgatcacattcatgacatcgaagaacttccgaaggtgttgaaactctgtcgcaggtcctttggtcgccctttccgcccaagcaatcggcttccttgagtctgggtgtgtcaggtcaacgttgaaaagctgcggatcgagtccagcgacgtacagcagaacgactttttgaatattgaacttgttcttgaccatgatccatggcagagtgggtgtttccatcagcaggtatactaccaagtcacgaaggtcctgttgacacacaaaatcaacatactgttagagggcgttccaataccatgaacctgaactcgatcgtgtacattcgaacagtaccttgatactcagtttgttatggtcgcggctaagcatgaacgacgaccggccgttatcgccctcagactttttggcaaactgcttgttcttcttcttcaagatcttgcgttccttttttgagagagtcatcacttcagagccgtccacggtgtctaatagtggaaaagtgatatgatcaaccactgtggcgaaccatataagccatggcgactgtccgcttcataccgttgtcctggcgcgaccgctcaatcttgcgccttttcggtacttcagagttctctcggtccgattccgactttgcctctgcagcagtctcttcattggcgtcctcgtcagcgggcatgtcgagaagaatgtcgaaggaagtaggttcgactatgcccactcccatgctgctgtcctgggtgttgtccgactgactcgattctccattttccgccaaggtcttctctacccactcgtgctttgctttgagtttccgtttcttgtcaagcatggatgtagttgtgaatggttggagggctctggcatgcaatgaaacaaaaaaaaaagacaaagagctgtattttgaaaactctgtggactgccaaaatttatactgcaggttttgcaagtcaggtccgtagaccattgtgcaacgagactaggacttcagagaacccagcctgtttcaggcaccgcgatctaactgacatcaacgatgcctccgatcgtaatggcgtacgctgcatccgagtcaataaaaagcacgcacaattagtactaagagtgagtggccactgatcatgtgtaagcacagcaaaactatgaacgtacgagcctcggcttcagggacatctgggctatcgtacaccttggcgatgcgttcttcgccccttccctttcgaagatacaatctcgtggtggaggcatgagcctataatacttactaacgtcagtaatgtaacttagtgagttaacacgcctttacgtatgccttctgccttaccatgatgtgcccgcccacgggcttcttggggtctgcaacaaatgtcatgccagcgccgggatcagattggacctggttcgtgagataaatagcgacattgaactcctctgcgatcttcatcaggcggctgagcatctggttcagtttctgctgacgctccgacaactcgcctcggccagaaaagtccgttcgaaagagtgcaatgatgctgtcgatgacctagtatcgtcgatgcagatagtcggagggtcatcgctacataagcgttacatgctgacgaggatgctcgactgcatgaaggtgaaaagtgagtagtcgaaactcaccagcaggcggaagatgcctttttcctctgcaaatcgggcagctatctccgtgatcaagtccatctgatgctccgagttgtaagcacgcgcaacaaggatattctccagcgcggcttccgagtcaataccaaaacggtcggcaatagctttgatcctctcgtggcgaaaggttccctcggtatcaatgtacgcagcctacagaaattcgcagatgagtatgcaggttgaggtgcagcctcgcaaccctcgctagactaggcgcttcacctacttttccattccctcctcccatcgctgttggaagctgtgcaatcacgcatagagtgtgggcaatctgtgtctttcctgttctgaactcgccaaaagcctcagtaatggacatggtttggataccgcctatataagacgcaggggaggcgcgctcttaatttccgccaagcaagaatccggtcagcaagggcatgcgagacactaacctcccaaaagttcgtccagttgcttggccccagtggatatcaccatgaccttctttcgctggacgctgtattcaagaccggtaatgaacgacgcactgtcaagctttgcagcggcttccttgagtttatccactttcgtctgagagcaacatgggtacatagatggtaagcttgagcgtattctagtaaggacatggttgccctagggccaaacaacgtacctcagaaaagcctttgattttgcacaatgtctttttggtcatcatctgcacgcactgcatacggtgtagaataaagtcaatgtcatgttaacctctgagtcaagtaacgccagcggttcgcgacgagaggcgtaaagaaagtatggtaacctacgcgaacagtgcagatccccgctagcttcagcttagtgatgtcggctgcattgataccgtggttctgcagctcgtcgatctctgcatggaatcggcaatttggtggcgtcagagcctccgatttcagtagtcgggtaaacgggcattgactcataccagacgcatatcacgacagcaggcttaccagtgaagaagatctcctgttgatgaacgcgagatggtaaagagtatagaccacgttcagccaacatacgatcgtctgtgatggcgttttctgcgtcttctgcttagagcgattaacggtcaagagtggggaaagtgcttacttcgttttcttcctcctccattggatcttcaatatcacgcactacttgatccatagccattttgacgagccgcgatgatttcaaaaaggcactgggaacaaaggagaggagttgagagagcaaaagggtaaggaaggtgatcgcgcggttcaaaaggctcttcgaacgtgtggcggcgatccagcgggcgtgtgactgtcgcacacaacactctctcccggttggctggttcgcgccagactcacgggcgcacgttcgtcctctttgctcattgacctcctcattgacctcccctttgttctcccgagtgcatgctgataaccaaccctcttggcgcattctaaccccatcaaggacagcaccaatcgatcaatcaacaagacactcctcaccatggcaacaggcatgctctcccgtgctgccagagcaagaatctcacgctgcatgaacccggcttcagccacgcctttggcccatcccttccgacaccaccgtatcgcacacatccgctctcagtccaccagcgcatcagcagcgggggcctcagcagcaccaccggagcaatacgacgtggttattgtggggggaggaatcgcaggaagtgctttggcttgcgccctcggtaggttacctcctacgctctccttatagcggtcatcaaacccgctttcagaatatccgaaaatctcaaccgccttcccattttgcgccatacccgattagcatcagcaaaggcctcaggtgctcagaggatcgcccttattgaggcctttgatctcagcaaccacatcaactggtcccctcgcccggatcagtactccaaccgggtgtcctctctcaccccaaagtcggtcgcgtttttgaagaggatcggcgtatggtcagaactggatctttcacggatcgctgcctgtgagggcatgcaagtatgggacggagttagtggagccaggatcacgttcgatgccgcagatgtgaatggcacgcaatccagctttttgcatcaggtcttctcaggcaagctgccgacaacggcgccttttaatagcagcagcagcaacagcaacgatgacgacacgaccctcaacggccaagagtcctcacctttggcttggatgacggagaacctgcatgtccagcgtggattacaaaagcagatcatggcgcatcaggcccgtggtgtcaagctcgatatttttgaaaaaaccaaagttcagagcatcactgccaaccaagccgactcgaatatcgctcctgagacggcagcagagtcaatggatatctcggattggccaatcttgcagctggagaacggcaagaggcttcagacaagattgctggtcggagcagatggagtcaactcgccagtgagatcattcgccaacatcgagtcgctcggatgggactactctcagttcggattagttgccacacttcagatcgaccctaccacatcaactgccccagggcaaggccgaggaatcgcatggcaaaggtttttgccaacaggccctgtcgctatgttacctgtacgtactctgcattacattttttttctcgagacagccagatacgttgtcctacagttgaaagtcctaatatgtgtgtgcgttcctttcgtatttgtattagctgaataatggctatgccagtctggtgtggtcgactacacccaaaattgcccaggacttgaagaaattgccagcacgggacttttgtgcgctggtgaatgcagcattcagtgccagtcccgcagaactcgagtatctgtacaagaacattggtcccaatggtgaaccgctggtggactttcaacaggaaatcgagtggcgcgcaagtgtccaggacgcagagccttccaaaacaatgctccgtggaggagcatatgcagatgccaagcctcccaaggtggtggatgttcaagagaacaccagagcaccctttcccttgaggatgagaaactcaagtagttatgtggaagatcgcgtggttcttgtcgggtaagcaacctctaagcgtgtttagcgtcttgaacctgacggttcaggtgtttcaggtttttgctagagcactcacttctgacatccaatctgctgggatcgttgatagtgacgccgcacatactgtccaccctttggcaggccagggtctgaaccaaggcctggctgatgtggaatgcctcgctcgcgtgattgagcagagccttttgagtggatccgatattggtgagctatcaaatccatgattgctgcgctcatactcgccagggtgattctcgtgtacatatggctcttgctgaacatccactgctctgttgctttttaggtaacatacattccttgacaccatactcaagcgagcgattcttgcccaatctggccatgctcggcactgttgataagctgtccaagctctacaacacggatttcggacctgtcgtctgggctcgctcactgggactgacagccgttgataatatgggacccatcaagacggaaattatgcgctttgccatgggcttggaagaaccatcgtcttcgaaatagttactggagcagcagcttctgtcatgcgcatggtacctcgataagggcttctacagaggcataggctttgaatcaacatgttgatgcaaggtaataaagttgaaaagggtggtttatggtacaggttctatatggcgattgtttggtagtggggacacggcccagttacaagggtgactgtggcaaaggtatcgggatgcatcctcctgaggggaagccggattggcctatgcctcagatgtgcttgtaacgtggcgacccagagtagagacgctaccgatcttgacctcgttgatgctgtggtcggagctggacgaccctgtcttgggctcgcccacctccatcgagtggtccacaccactgacggccacagtcttctcgtccaagtggccgtaagcggcctcacccagctccgcaagatccaaaccggtgtgctcgtgatgggcctctgcgcgcaggttgaggccaggaatcttgttcatgatgaagaggatcaggtaggtcacagcgaacgaccatccgagaccggccgccgaatccgcaagctggtaaccaacctggatccagttgccatccaaccatccgcctttgatcacggtcacgccatccagcgctgcaacccattgttgggcaaagacacccgtcaagaggttgccgacgattccacccacaccgtggacggcaaagacatcaaaggcatcgtcgtacttcaagtagtgcttcaggcgaactgccatgttgcaagcacaggcgcccaagaatccaatggcaacacttgatgcaggagaaacgtagccggagccaggggtgatagagaccaatccagcaacagcacccgagcagaatccaaggactgacagcttgcgatcgtggcggtagtcgagaaggacccatgtgatgccaccgaccgaggccgcgagattagtgacgacgcaggccatggcggcgcgcaagttggcggaaagagcagatccaccgttgaatccaaaccagccgaaccagatgaagcaagtgccgatgacgacgttgctcatggagtgagggcggaaatccttgtggtcgccagagcgtctgccgaggacaagagcgtaggccaaggcagcaccgcccgaggaaatgtgaacaggcgtgccaccggcaaagtcgaggccgcccataacaaagctccagccattggccgaccaggtccagcaggcgataaagtcgtacacaaaggtggtccagagaaagataaagaccagcgtggggaggatgcgaccacgctcagcagcagcaccgatagccagtgctggggtcaaggccgcaaacataccctggaacagcataaagacaatgtcggggatcttggccgagccgacagagggagcgtccagaacaccacggaagaaggcgttgtcaaagtttccgatcatgctgccaccagtcttgctgaaggccaaagagtacccaaacaggaaccactgcattgcaaaagtgtgagatagggtaaaagtaagcttggtgcgcctctgaatgatcggatcaagtcttcctttgagtgattggatggagaagagttccatacctggaaggaaaccacagcgacagaacagcacgagagcatgataagcgataatgcgttcttgctgcgagccatgccagagtaaaagtagccgatgccaggaatcatgagccatacgagggctgtggaggcaagggtccaggcgatgttgccagcttcatattgtgacccgatgaggggctgttctgtggagttcatcgctgcagtatgtgtgtcgtgtcacgcaagtgcaagtcaagatgggtgtggtgtatgaaaaagagagagagagggaggtgtagtgcgatgcactatctcgtcggttggtaaaaaactactatgactgagccgaggggtgcggatgggaatcgtagcaaggatcgcggtggaatagattgttggaggcaaagagagcgggcagacgatgaggagagtgaaggaggtggaaggggggatctgcactggagtatttatacgcatgttctgcctggccagaacggtctcggagagtaaagtgcatgcatacaatcgagttctacctagtccgttattccccacacacgcactcgttctcggacattgcaacgaatgcgcccgatgcacagttcccgctctccctctccctctcgctgtccctcctccagcgcattcgctgtgcaatagagtcatagaatacgattagggccatacgtctatcatggattgactctgccgcagacacaagcaatgggtgagccgtgtgtgtatgttgtgtgagtgtgtgtggtgtgtgtgtccggggatgtcgttgggcctgcaatagagtttggtgcgatagagtactctgtttgtttgaatctttcataatgcgctcactcgctgtggcagcgactaacagatagggcagcgtagggcagccaaaaacgcgagttcccaaaccataactctgaacacaaagctcgtaccatatgataccacctcagccgatagtgacagccccttcgcttatcccttaaacgccctttgcagacacatggcatcgtcatcaaatcattcgttgccctcccagacctctgctgctatcgctaaattgccaactgcaccaccctggtcccgaagccagtcaacggactggttcttgaacgacaagaaatgatcctctcgtagctaattttcccgcattcttgcattatttcctccctcccatctcgctctctcgctcctctgcagtaacaacggcctcggattctgaagggtgccgtctccggatggcaaggtgctcacaggcatcaccggccagcagtgactggctgaagatgaaaaggtctctcaagtctcgacgaagatggtcaagtttgcgccactggatctgctctcgagcgccgtcgggacttgtgatcattcatgcatgggcttaagcctggacccctcatctgcgtaaaagactacaatcatgaccctatttatccgatattcggtgaggtcccgcagtagtagccagagcgagaaaaagggcctagagagagcgagggaaggaatttgcttcgagagcagtatcttgaatcaatgcaaagccgggccaaggatgaatactgttgtgcccgcattgaccacactggatgccctcatagaaggctgagaggctgagaggctgagagtagtggaggtgcagtgagtgcgaacttttgatacgctatcaaactttaaacacgaggcgacctatctttccacatggttatgagacacactgcaatctgattggccgagagttacagagacaaacacgcgtccactcagacacatggcgttcgttatcgaggccagctgctgtatcctcaaacagctgctgtttgaacacactcgttccttctttcatccctcaccttgtaaattcctgtgtttgattgtcccttcctcctatttcattgttgtgttctctggtctcagtgttccgagaacaccaggtgaataaccttgtgagttcgagccctcaaatcgtcatttcccgatctcctttgttgtctccatccgggtcttcgttctcatgataatagcactcaggagcgagagcagcttctcgttgcgggagtgtgatttacctcttcaaactcgacgactttgctatgatgcgtgtttttcttgtcgttgcaacacgacatcgttcgccttgactgaagtgctcaaatttctgttgttcaacgcttcaggcacaaagcaatacggcaggacgtttccccgcaaaaaccatatttagatccctggcgaaccaagctactgcatgttcaaacaaaccttttactttgtgcttgcagtgtactgtacagtggaggctcctagacccaagatacgcgtgtttctttggtaccctagagtcatcttaacgccgatctcccctttatgtttttgtaagatatgaatacgggacagaggaggagtttttgacacgaagagagcaacaaaaaaaaaaactcaatctcttttttctttctctccataattttcttccgcagatgtgtactttgatcgactttgccactttgaatgttacccagatgcgtgcgcttccatttttcattcatccaaaccccatgctcccctcccccccacccttttagtcttggactgcatttgcgctcacagctgcatgcagacaggcgagcgcgttttatttacagggaagctgctatctatactttctctcgctcacactcgccttcttcctctcgctccaaaatatcgccaaaattgtacgaaggcgcagggcactgtgcatcatcccgtcatcctccttccttttatctcgctctcgctctcgctcctatttccacttttgctacccctttcgtctttgcctttcggggttgacttccgctttcgatcgcatctctccggatctctgttctgagcggctgttactctagactcaggttagctcgcagggcgacgtggcttacaacacgcttgcattatcgtttgcttttggtcagggattcggtttgcctccctccccctgaaggtagagggggacgcacctgcccgttgctcagccgggccctggactgaaggggatagtaaatacgccataagatatcgctagcgtgctatgcttgcagcttgaggcaagggcgaaccaaggcgccccgacaaatatgtaattactttgctttttactctaaaatctggcttatgtacattatatactggagctgcagttacacgttcgcgggtgtaggtgtcgcggcacggtgatgattaagcgcctcagggttactctgcgagtcttgcatcgccatcaatcgctcgacctctgatattcgcgcacagagaacaaaaaatcagcaatggtccatatacaaactgcacgtgattatagttgtgcttacgcaaagagggagagagtgtgtgcgtatccatggatacttacttgagataaggtgctttccataggtatacttcttgagcgaggccagatggggtttgatctttgccactaggacatccctctggtcaccgtcaacgacatccaacatcttctggaccacgtagtttgcaaactgatccttcatcatcaacaccaacggggatgtgccgtccgcttttgtggtgatcacctcctcaatcagcttttgtcggtcagacttggacccataagcaacacacttttcaaccacattgctagcaaacttgtgcttgctcaatggtagaacctggccaaagatcttggaaatgaccagcgacttttccgaaggtttgccgcgctcaagtatgtgctggatcacatagtttccatattgatcctgcaccaggtttgggatgtacttgtggagctcgtccatcaagggctaaaaaaaaagtaacatcatggtatcgtcatgagatgtcgtgttccggtgcatttcacggcttcttagaataaaaggacactgtaaaaatcttaccgtcttgatatcagcacagtgctcaaacatgcgctggatcactcggcagccgtagggatgtgtggcgagggaatacacctgtcccgagaatacgttaatgatgaattgaatatgctccgctggaacacactcaatggccttctggatgacatggttcccattctggtccttgacgcatttgagcacattgccatcgagctccttaacaaggatggcctgctggtcgctcaagacgtgctccaaccctttctggacaactcggcagccgtacatctgcagtgccaacgagagaacatgaccttccatttgctgagcaagaaccgttttatgatcttgctggccatgctcgaaaaacttttgaatcacatagtttccaaacacatccgtcatcagctgaagcgcgtgcggcataatttcttcaaagaccatctccttctcctcatcggtggccgtctcgagtttctgctggatgaagcgcgagccgtgctgatcgctactgaactctacgacacttccggcaatgtcctattcacaagatcgcaatgtagagcgtcagaataaaagacatgatgtagcataggcgtgagtgtcgtagagattctacagcctaaacttaccttaagatcgtacttcttgctgctcttgttgctcctaaagtcttccaacagtgcactacgctgaccatgtccaccctctgcagttggtgcatcagcatcttgttcatcggaatgctgtctatgattatagtgggggggactggtgttggaactcgaccaggaggatgcattgtcaggttcagaatgacccttcgaatctcctttgtgattcctgcttccctgcgcttgctttgatcgaccttgctgtttcgatgagtgatgctgctgttgctgctgcttggtagcatgctgtgcctgtggctgctgtacctgctgctgttgttgttgctgttgttgctgctgctgtaggagcagcaattgttgctgttggagtagaatctgctgagactgaagtcggagtttctgctctgccgcagcattcgctgcagcaacacgagcgtccacgtgagtcaggttgggggtgctcaatccggatcccgttgacccacccgctccaatatagtcagacgagtatgatcctgacaccaaggggctctgggaatacatggcgctactctgctgctgctgctgctgctgcaactggagcaaggcggccttgcgatactcgggggagagattcaaggccgtgttcactcgacgaggatcataagctaggtcattggccctgaagcccaatgacgcctcatcgtggccctcaaacatagagtggaaatctatcaaattatggcacataagtacaactgcacttcattcgaggtaaaactcagagttcaaagatgtgaccatacctttttgagcaggtgcataatgatccttctgagccaagaagccagggtgtgtcatgagattatagtcgattccatattgagggttgatcaaggtgggatctttgagcatcgtctggctgtcaaagtaaggtgagtatgcagtgagtggcgtatgcgatccgtggtatggctgatccttgtgctgaagatgatgaagttgctgatgctgctgctgccgctgctgctgcatctgctgcagcttcagttgctgttgattcaactcgtattgttgtctcctaatgtttgcctgctgtatagccaggtcatcctcctatacaaccataaggaaacacatatgggccgatgttaaaaacgcagacttgagggccgatgaaaacatactagacaagtatcgggcatgcgactatacgtaccggatccgtgaactgcaggttctgcatgccaaattcgatatccgcctcaaaccgctggtctatggagaacccaggagggggatgtctcgtaaaattacgtccgtgaataggcggtgttgaggaggaacgggttggaggggcaaatttcgactggaagagtggcgatcgaacactgctgaaagtgggcatccgctcttcatctccaccatcaagcgctgcgttcaaaaccgacttgaggtgtgacgatctgtcgtccatgtcatctacggccagtgcagtgtcccgcagttggtcatccagctctgaagtgtcatgcgtctcgtgtcgcagtgtcgatgactgggacagaggtgagcgcagcgactgactggtggggagaccttgagccaagagatggtgcgattgttgttgaccagaaaggtggctgtggtgaggcagattgagcagtggggagggcgatcgaggaaaatcattagctggggacgacactgtcggcgcccatatatggctcatatgatccgtggaatgggcgctgaacagaggcgagctgggcatggaggcgacactacgcgccggatcaagtccataacgcggcaccatgggggaatgggcttcgcttctaggcatttcggaagtcttgagatcttggcgccagagcagagacggatccgcgcttctcggatgaagcgagggggagccgagcggagcgcggtcgtctgcagagaccccatgatctagcggtatgccagtgacaacacgatgcatgagaagaatgcgaacaaacaagagcagtgagggttataaataagaacggaaacggactaagggttagctgcatgcattaggacatggtttaggatgcaaggctcttgaatgcatccaattctgcgtctgatacatcagaaggaccccatgcaaagcggccagcgtgagtgggaaggcacacaattatgagacaactctacctagtcgaccgatgctgccagagagtggtgtgcccttgaggtcctctgatccgctcccaaactctgaggtcgtggaccacatctgccacgagagtcctggcgagtacatggtggaagcagcgaggcgaggatcttggcgcgcgggtggcatgtacaggttactgtaggcgatctcggaccgcagatccgatgacggttgcgagtcgaagcctggccccacgccaaaccgtgactgggcttggttgggcggcgcggagctcgaacgcgagatgtcgaggccgtggtggccgggaaggccggagaagccgccgccatagtcgttcagtttaccacgaagaagattcgcaagctgctatgtggaggaagttgcggaggtgaggaagacgcaaggtgatggttggcgaggttcaagagacccgagttgagcaacctagcgaaggccgcttgcatgcgtcaccacagcatctcgccttacctgtccttgaggctgatgcatagtcgtgggctgatggaggttgccgtggccatggtcagcggatccaacttgggccatgttgctgccactgctgaggctctgatgaaactggtcgtccatcggcagccttggcatcactgcagaggaggatggctgtctgaggcgtgctttttgtttgaggtgttctcttgttcttttcgttggttctactgctgtgcttgttggcaactgggatcaccagcacgtgtgggtctacgaggtgcgctctgttctgtcagcagcagatgggctgagaataggtcgggcaggaggaagggaacagatgatgatgaagagagcgagaagaaaaaaaagaagacaagaaaaacacatgggttgcaaacgcaactgggtgcagaccatgcgatagccgatcttccctgagcaccagatcagacttgtgcatgggtcgagcagaggatcaaagacaatgcttttctcgcaagctccattcatcccctcgccctgcgtgtgcctcttcagcctctggcctcctccatcgcttttttatgtctgcagcgcgcacacgctagcttatgtgtctccctttcccttctcctctctcgttctcgttctgtccttgtcgcgtttcggcttcgctcactctcttcccttgcgtgtgctgaacggaaactctaattgctagttgcccgaagaaataaaaaaaaaatacctctcctgccgtgtcccttttttcttcctgcgttactgccatcgtcagcgagatacacacaggttcgtcgtttctggagtaaagaccgtgcttgacagcccctgccacataacttggacgcaggtttgacacgcacgccattgcttcctttcgaggggtggtttcaccatgaatgttatgagctattccaccctactgtagttggacgtcaggcgcagttcaaacgagaaaagaaaagaaaagataggaaatagagaatgaagagaaagaatgggtgattgcctgtgctcacctactgggactcgaccgttcgctcagcaaccctgcgaacggcactccaggctgtgcctctaaaaggagcagcatccgaaagaaaaataagttttgtctcggatttcacactgcattcggacacagggacgacatcggatgttgtccgcctgccagctggaggtctcttgtgcgcgatgcggccccactttctcgtcgtccggccagtatcgttgcgatgcgcctcttgtccacccgatcctttcccctgtgcgcccactaatgtgcaggctaccggtgatgtttgcgtcgagcccagcgattaatcatgccacgtcctggcttacctgcctcgccatacgtcagggtgtactctccttccctgggaccaaggcccctgcaacgacatgtatgaactgtctcaccttggatcgcagtgtctgcaaagtggcctgatcggtgagccacaaccctccgaccttatataaaacaatgtgctgctgcagacacttgccttctcatccttcaccttcacttcatactcccctattcatttcttgtggtatatcacattttccctcgactctcgtctctccccaaaatctactcgatgcctggcaatgcacccactttacctttggccacagtgcctgcgccaaaggcaggatcaagctatgacatgattgttgttggtggaggcgttataggatctgcattcgcagcaacattcggcaagcaggggaagaaaatcttgttaattggtatgttgagtacgcacggtccatcctgtgtagatcctcattaagtgcaccaaggaacacgttaggctaactagcgggatgtttgttgaccgcctcatctcatccgtagagcgcgatctcacggagccggaccgcatcgttggtgaactcatgcaaccaggcggatacaacgctttgaaagagctcggacttgccggtaacagttgcagtggtattgaaatcggattcgcactgagcgtcgctgcagccgtctttgctgatagtgcttggttatcgtgaatagactgcctagagggcattgatgccattcccacacacggatacggcgtgatcagagggtcggaacatgtccatattccttataccatcgacccagaaactggcaagccctcgcaaggtcgttctttccattatggacgattcattcaaaagctcagagctacagcctcgcgcacaccaaagtacgtgctccagattcagacccaggatcgtgtacaaaatattgaccagagtgctaacgtccatacacgcctattatgaacctctagtgtcgcattggttgaggccacagtcaatgaggtcctttatgaccaggatggcgtacgagcaacgggcgtttcttgcaccccaaagagcgctaccgagactgtgactgcaccctcgataacctacaaatcccctatggtggtgattgccgacggctgcttctcgaaattcagaaagcaatatctgaacaaggaggtcaccgtcagttcacactttgttgggtaaggcacatgcgctcaatgttgtaacgtttgaaaaacacttcgttctgacataggaggactaacggccgtcgcaccacctcgacaaacgttcatttcagtcttattctcaaagacgttgtccttccctatccaaaccacgggcatgtcattctcatgacaccttcgcctgtgcttatgtaccagatctcaacgaccgaaacaagggttttggtcgacatcccgggaaagctgccatcagcgtccacgggtgccttgcgctcgtatctggaaaagaccatctaccctcaacttcccgctactgctcagaagccgtttctgcgcgcattggaaactgaccgcctgagatccatgccaaacagcttcctccctccttcgaccagttccgaacttggtatcattgtgcttggggacgccatgaacatgcgacatcctctcaccggcggtggcatgacagtggcactgaatgatgtagtatacctcagagacatgctgaagggcgatgtcacaaaggaccaggaggtgaccatggttcagatggagctgttcttctggaagagaaaggagcttagtgctgtgatcaacattctggcccaagcactctacgcgttgttttcgggaacaggtacagtttgacaatttcatcacgctgggtaacgttgcgtttttccttcttgggcaatcaactgaacgttaagctgactagtccacttcttttatgtgctcaaatagacggaaacttgctaaccctgcgagatggttgtttcagctactttcagatgggtggcgaatgtatccgtggccctgttggcctcctctcaggcctcaaccgcagtcgaaagaccttggcatatcactttttccacgttgccttccattcaatctggctcatgttccacaacgcggactcctatgcagatttccccatcctgttgctgaaggcgtttagtatactctggacggcatgtgttatcttcttgccccttctgtggactgagtgctgggcgtagatactgtcaactctctataaaggaaacaaatagtgaccttatagcgctcataaaaatcatcgcctatttcgtactttcgtacttcatcaaccgcacaaccaggacgacttggatggtgctgcatttcaagagagtgcctctgcccgtatgcgtatcgcgccgtttatctaagcaccaatattagatagaacttgcaatgaaggcattattgcactgactctcataattagtgtttttaatgtcaccgttgcaactgtatgaagagttttctcaggctgacggtcaactcacatgcagcatcgtttctttttttttgccagccgacatcctgttcttccgtcagattgaaatgagcatgcttctttgaaagaagagaaaaaaaataacgcgagggagaggacctgagcgcccacaatgagggaccatattcgagacgaggcggaaaatgaacacgagccaggaacaagaagggattggcaagaatttgtgtgtaacaaagtcttgatattatttgaagcgggagcgtacatcgcgcgagcggaatagggcgaggctacaggacgctggccgtgaaaagatgggatagacccacagcacctggaacaagggtctaaatcacgtttccaactggtgtcgaggtctctcttgtggaggcaactgtgagcaagggtctggcggagttgcgagactaccatatgaacgtggctgttgatcaaaagcacatttcatctttacgtcttttctctggcctgccgtctttcgccttctctttctcttccgacttcctcgtctctctcgctctcctcgtccatcttgtccgcgtcttctctctggcctgtcgatctcacgtactcttcgccttgtcaaatatttcttttttctctcctgctctcctgccgttgctcagcccattttccgatatcgccctcatcgtcctcctgttctcgtcgtccgctcgtacatcgccgaccccatctccacccatcgagtccgctccttgtggcccacctccttttctcgtccttgcctcctgtcttgtctcgttctctgcttgtccgcaaatcttgccgcgcatcatccattcttgctgttgctttcttctgcgctcttcgcatattgcatttcgttgtcgttcttctcagctctcgccttgccgtccacccagcgccacgccgccgtccttcgaccatgggcaatcctgcattttggcagctcctcaatcgacttcaagtaactccaaaagaagctgaccctctggacatggggaccgtccacatagacgtcctggcttgcttcttcagtttcattacgagcagggactactttatcactcggaggatgatcagagagaaaatggaccacgaaaccttccaggacttgcaaaacagaaggatcgctcgcctcgccaccgccctggatgccaggatgagcgctgtcttcgacaaggcaacagcaattctgcacatagatggtcgaagcaccatccaaaaaaggcacgctcacgaaaagcgctctgtagtgcacggcaagcaactcactagcctcaatgagaaggtgaccaaagtgtcctcaggatggcaggcgaaaacatcagcatctaggcgcaagttgaaaaaactgtaccgctcagctcaaaaacaatggaggcgaaccatacgcgtcgatcgcgccactcgagtagcgctcgcgcaagcactgcggataaaagggtggcagacatgccaatctgacgacgagacagggacctgcagaggagaggccgacgtttgcgttggaatcacagccagtcgtcgtccacgtgagcttggtcctcttgtggtcgcaaccacagactcggacctcctcgtgtacaacaacgtatccgttctacgacagcacccgcgccgcaagtcctcgtattccttgtatgtgcaagacgagtaccttcccacactcaacaagaatcgaccgaaggtcaagcgtggcaagaaggccatcaagcgggttcaggtgctcacgccggaggtctggaaagtcctcgcaatcgtctcggggagcgactatgacgcgaacgtgaaggaatttggagtcagaaaaaattgggccatcttggcagacatttggagccggattcagcccgcctcagagacagaccttcttcgagcgtaccgccaagaaatgtcgaccacgcgcaacaaggagggacccctgcttgtcccagaatttaggcatggtgcctcggtttttttgaatctcaaagaagacacagaggaagacgctccagacccggccacgcacgaaaagatcctggagatgatggctttgtatgccaggacggtccaagcgtgcaaagccgctcaaggagatcaaacaatgatacgtcgggcaacggggatcgccgcgtctaccaagggctacgttcgacactttcggacgagcggcaacccatatcggccaaaacgcatcaagcctcgatcccttcagcctgtggctacgacgcagcatgcatcaacggtatgaccattgaccattgtatcaagttcgcttcattcttgaaaacacattgaatagcataggtactgactataactcttctgcttattctacaaactttcactcttctgcctcttctttttcctgttcttctatctccacattgcaaaagagcaccaccgtcaacacaaaccccagaaagggaaagcgaaaggcggaaacagaggcagtcaaggtattgttttagctatgcggacagctcagtcatgatattttatcgcaacgtaactaagcctttctctgtttctactgccattattgacaggccgtagcaagagaggacaaaaaaccaaaagagagggtcatcagatccgctcgatggatgcgagaggagcgtgatcttgctgagagggaggcccaggcccaggccgcaggcaccgagctggtcaggcaccgcagaaagacgaaccttggccaactcatcaaccaggcagtaggatccaagtacgagaccgtcaccatgaacgtgggcaccatccgagcatgcctgcaaggagccttgcctaaatgtgtttacgcggcatctacagacttgctcacggccatgacgtgcgacattacctcaacgatggcagggttggcgaaactcgcctcagatttgtccgtcctggcaacgctcgcgcttcagcattacattgcaacctttatggcacagcacccctctattcacgatgcaaaggccagaagtgctgctttcatgctcctctgcaaagggcaaagtttctttcctgcgctggtcaagcagatctacaaatcgactgcaggatatgataaacgggacactgtagacgcccgagccggcaaggacgccgcgcgagcgttcttgagcaagtttgagagcgacctgatagcaccgctcgagcgaatgcgccagcatctggatcaccttgcacccaaaggcttcctcgagttcattgccaggcatctgagtgatacttttcgctctcatgccgatcactatattgtcatcttaaagcgcagggtaagctgtagcaaattgcatttgccttgtctttgctctgcagtagccggccgcgactaataataattttttctaccgcttgcgcatcactcaggttctaacaagagcacccggatggtcaacaggagaggcgtcgacactcttgcgctcgattaacgacaagacagggaagtcgacagaccacgacccagtttccttgacctggctcatgaatgccgcgctcactgaggatctgcggatctcgttgtgcccgaggccagggtggaaagatggctttgtaacgctatcagagacgtacttgtacgaggccttgaccagatccaggaacagcaccgaggaggcccagctggtcgagcagtaccagatcctattcaagccagaagagggcacggcggacggcgacgtagaggttgacatctttgccaaccatcggggccaaatgaccagaaatctcttcttaagcggacgcacaaatttctcccgccatggcgccgtagggaatcctggtgataaatccttaccgtccttgttcgacttcagcacgcccgcctatcaggaggcaattgcagctttggagggagccgggggcgccgattatacgctatccaaaaagcatttcaaagagctggtgcagctcgatctagggtctagataccctcgcccaccttatactggccagcagacaagagatcgcaagtaccttctttgcggatcattttgcaccgacggttaccaggtgaagctattggcgtaccatctggatcacacgaagaaagagcagccgactctgaacctctcgccttcgtcgtcctcgccttcgtcgtcctcgccagccagaacttatcggagaaaggcaccctacataaatgaggcgatcaaaaccccgcacgaaatcaagtcggcgctgggtgaaggaagccggttggtcggcagcatcgaccccggtctgcgaaagcccgccacatttatggtggaggatacgttggacccacagtacaggctgatcatcgacatctcctgtggggacctggccttcaacgagaggcttttcaggagccgtctaaatagggcaaagaatgacgagggaatcaacgagattgagcagagtattgtcggcttctgtctccctgcgcctccagcttggttttcgaatcagcccttgccagaccagcccttgccgaaccactcgaccgtctccgcccccaccatgcagacgtaaccgcgtcgccatctcagtccagcacggggtctagaggcgcaaccgcgtcgccatctcagtccagtagcgggtctagaggcgcaaccgcgtcgccatctcagtccagtggcaggtctagagacgcaaccgcgtcgccatctcagtccagcaccaggtccagagacgcaaccacgtcgccatctcagcccagcaccacgttccaggaaccagaagcgagctttacagcgcacactcggtccatattatcatgcttcaatcagttgcgaaccttatacgaatctgacaaatacaagaggtggaaatatcaggaacagcagggccttagagcagaatatggccgggctgtgaacagcatcctctctaccctccaaaccccgacacacgacaagcacccgtatatgcatgacatggaggctatcagaggtcgacagccaattctaggaattggtgatggtaacttcgctaaagtctggtctggcgcagataaaagcgggaagttccgggacgttctggttggtgaggtaggctctcccgtcttgatgcagcggtggaagctgcagcatgtctcctctcccgcttcgttttgtccacacaaccatactgatttactttgtctcaccataggcattgggaagagggatactgacggttcagcttgatgagtttcgaacgtcagcgacttgctgtgagtgtggatctaaaaacaaggcacaaggccgcagcgtagtgtgtcaggagaagacctgtggaatcatgaaagaccgcgatcataatgccgtccataacatgaccaaaggcatggtgatgtggaccacaagacttgtctggccccagcacctggatacgagacactgtggtcaagatcgattatgaagttccggcgtagagcagggaacattaactacggttgacagtaagtgtcgctatgagttctagaaaaacctctaaggtattgtttcaagactaaagtcttcgtttcctttatagagagtcgactgtaaacagctgaatataacaaaaacaaaaaaattatgatgacaggagagaaagccttctcctacgaggaggcgcttggcgtgcaaatggaattccgcgattgcgggctataaataaaggacacatgcctggggctgagcactgctcgcagcagaacggccagcctggccactcacgacttccaacggctgtgcagccatgagatgtcatgatgcccgtcacacggagctacttcttcaagacgagttggggcacactccccgttggaaaaaaagacgacctgttgcatgtacagccgcacgctgcacgctgcatgcagcaccacttgtgcagctaacatgctgttgttgcgtgccttggccactcccgctgtctgagcgcacaagcctactacccttgaatcggccttcgcgcacacacaagtatatttatgggatccaatagttttttttcaattaccacactcaaatatggaactgacaggctcgactttgccaaggacttagacatatggtggtcgggttctcgacctgtcagccagatctcagtcgagtggatggagagggaaatgagtagtgaagatatgaagttgggataggttagcctttatcctcaacgagagtcaatgagtccgactttctggacactgatggccaaccagcaccagtgcccacataaaccaaccccagtgcacttttctattagagccctaacaccttcctatggcccatagcacccatatcatcaccctcatccgcgcctctcattggccgatcagacctcggttcttgccaatgctcgtcgactagtgcaaacatcgtcctctggcggtgctgccggtatcgttggcctcgccagagcaagggctttcgtccgagccgcttgaatcgctcgtccggccaaattcacaaatcggccagattcgccatttgcaaaggcccctccctttgctaaacgggtcgattccgctacccacatagtgaaaatcgccaatcgctgaaaggactgcctcacgcccttctcggcactttgaaacctcgaggttactaaggcggaatgagctggatccaccaggctgattagcatggtcaccttttaaagtttgggtcagctgacgatatcttgctatgaaggagggtgctagcgtgctctcgggctcgcgatgcctacctggcgccctcacaggcaacgccaggcaacgccaggcactcaaagcgatccgccacgactctttggcgcgtcgcacggtgtttctgcagcgttttatttcagtgtcacagcgcaaaaaccttaaaccaagtaatgtccagggtaccagcgcctatatacctttctatcggggctggttcttgcaaatggtcgttgccggtgcaaaaacgtttataattcgatgctgctggtacagttggcttctcccgagcgagcgctttgtcccatgcgcttaatatacacattgtaaaagtttccgtaaatttggtcctttccgcacaccgttcatcgtctttctgcctttgaaaagcagctcgattccgcaagtcggatggtcacgatgagcaatcgctgaaaacagtgcctcacgatgttcagaacacactcacaggtcgggaaaagcggttacaacaatcaggcgccaagaatcgctttagcccgcttcgcatccgaaagctgcgcacaggtgtttgaagacggtgacagggtgcgaatagaaccaaattcacggaaacttttacaatgtgtatattaagcgcatgggacaaagcgctctctcgggagaagccaactgtaccagcagcatcgaattatcattgtttttgcaccggcaacgaccatttgcaaaaaccagcgctgatcaaaggcagaaagacgatgaacgggtgcgaataggacccaattcgcggaaacttttacaatatgtatgttaaacgcaaggaacgaagcgctcggccgggagaagccaacagtaccagcagaattgaattatactcgtttttacaccggcaacgaccatttgcaagaaccagctccgatagaaaggtatataggcgctggtaccctggacattacttggtttaaggtttttgcgctgtgatactgaaataaaaggctgcagaaacaccgtgcgacgcgctaaagagtccttgcggatggcattgagtgcctggtgttgccttcgagggcgccaggcaggcatcgcgagccctacagtactccagccctctcactgatagcgatctcgccgtcatttgaccacaacttcagacggcgactttactaatgagaatgttggagaatgatcttggttatgcattcggatcgaggtttcagagtgtggagaatgacgtgaggcagtcgagatggcgattggagatcttgacgccatgagtagccgaatcgacccgtttgccaagatgagggacctttgatcatggcgaatcttgccgatttgtgaattaggccggacgagcgattcaagcggctcggacgaaagtccttgctctggcgaggccaaccataccggcggcactgcctacggaccattcttgcactagtcgacgagcatgcgcaagcatcggggtctgatcggccaatgagaggcgccgaatgggatatgtggatggtccatatgggccatatgaaggtgctagggctcatagtaaagtagtagtacaaaagtacttgtgcctgaactcgatttttaaggttttcgtgcgctgcccgtgcaacaattcgctgcaaaaccaccgtgcggcctgtataaaacgctagagagtcatcgtggaccgctggcgccgctgtccagggcgccaggtagccattaaaggttctagagcctctcgcagcactctaccatacacctatacactaacacacctctgcgctgctctcggaggcgagggtgggctaatgcgattcttggaatctgatcatttcaaacacttttcccgatctttgagactgtgctgaacatcgtgcggcactgttttcagcgattgctcatcgtgaccatccgacttgcggaatcgagctgcttttcaaaggcagaaagacgatgaacggtgtgcggaaaggaccaaatttacggaaacttttacaatgtgtatattaagcgcatgggacaaagcgctcgctcgggagaagccaattgtaccagcagcatcgaattataaacgtttttgcaccggcaacgaccatttgcaagaaccagccccgatagaaaggtatataggcgctggtaccctggacattacttggtttaaggtttttgcgctgtgacactgaaataaaacgctgcagaaacaccgtgcgacgcgccaaagagtcgtggcggatcgctttgagtgcctggcgttgcctggcgttgcctgtgagggcgccaggtaggcatcgcgagcccgagagcacgctagcaccctccttcatagcaagatatcgtcagctgacccaaactttaaaaggcgacccatgctaatcagcatggtggctccagctcattacgccttagtaacctccaggtttcaaagtgccgagaagggcgtgaggcagtcctttcagcgattggcgattttcactatgtgggtagcggaatcgacccgtttagcaaagggaggggcctttgcaaatggcgaatctggccgatttgtgaatttggccggacgagcgattcaagcggctcggacgaaagcccttgctctggcgaggccaacgataccggcagcaccgccagaggacgatgtttgcactagtcgacgagcattggcaagaaccgaggtctgatcggccaatgagaggcgcagatgagggtgatgatatgggtgctatgggccataggaaggtgttagggctcttatagaaaagtgcactgtgaaaagtatagggcgagcggtacctggattctttttttttaggttttcgcactgtgacactgaaataaaacgctgcagaaacaccgtgcgacgcgccaaagagtcgtggcggatcgctttgagtgcctggcgttgccttcgagggcgccaggcaggcattgtgagccctagagtactccagccctctcactgatagcgatctagcgtcatttgaccccaacttcggacggcaccttgactaatgagaatgttggagaatgatcttagtcatgcattcggatcgaggtttcagagtgtggagaatggcgtgaggcgatcgagttggcgattggagatcttgactatgcgagtagccgaatcgacccttttacagcacctttgctcgacgactgaaatatatccaatttcacaaggggccgggcggcctcttcagttacaccctctagatatcacgcaggctgtcatgggcacagacatatgctgtctgctgccgatgcggcatgccatttgctgatgctgctgagcatcggatactctcaagtgcagctgctcactgggcttttcgatactcaaggtggggaggtcacatcccgaaacagggcggccatgcatggtctcaaagaaatatcgggcactcatttattacgaaatagttgtttggaggcattggtatctgtgcatgtttgttgtggctacaaatagaagaagtggccaaaagaaacgcccggcgatcggatccagtgcgatcgcagtagggctcatgtgcttctgccgtcacttctttttttttcttgtttttttctataggcttcccgacaatgaatgggtggtgtttgtttttcggcgccaggtttctttttcgggttccattatccgcggtcgacatcgtactcccatccgggaaagtcctgtcggtgctcaaacatgtcaaccagtttttggttgaatggctcaaagacacgctgcagtcggtaccgggtcgagagctctaaaggtggatccgagtacaccagttgtggggagggtgatccacccgcatggttcgatgttcgacgctcatattccagctctggatcctcgctcgagtccaggatctcgtcttcgtcctgaatgatgatcctgccaactccaaagatcttgttatgtccagctcctccgtgtcgcaggggtgccatggggtccgtgccaatctcgatggggatgttcatgaaaggcgcgggatccaggttcaagaaatgtgccagacgcaccatggtggacacggtcgactttttgtcataaaggtcctcggttctcagcacaaggatcttggtgaatggtacgtacttgacaaactcgtgcagctgggaataataaaggcccttgacaatcaagttcagcagaggcgcaggtgggtctagttatgtatagaaggtcatgtggttaactcctgtcgagcaaacctgtcgccacaaaaagaaggctcccgtcgaaccgtcctcgcatgagtgcgacgtacctcgtgcattgttcgaccttgggcgattggggaggcccattcgcttggcggctaattttgtcataggatcgagtggggcggaggtcagatagatttacatggcgatggatacactccgtaaacaggtggccgaaaaaaaagatcattcgcacttactcttgttggcctcctccgagtgacagcgcaggaactctgtccactttttgcttcctgggcgtgcaatgcactccttgagtatcaacaactcttccgctacgatttcttcgaaactatatccagccgcgtattgttctgaatagggggtaaagcgcaagcacaagcatcagcaacttgagcagagaaacgcagcaggcccacttgacatgcgcactttgtcttgcattcatgacagtcagttaagctcaaactcactttgttccagatagttgagatatgcgcgatcgattgggtcgcgaaagatgaagacggccttgatctcgggcatggtgcttgcgatcctcttgctggctccgtccatgtgcagatagctgggagcacactctcccaccaggatctttttgtcattgaacgctggagtctcgtggtggtccatgttgacgtggctaaagccataatgctggatgtgaggaagagactctcccgaaagcactggattgtgggaggtcactgggatatccttgatcgaggggaaatactgcagataccactcgaggttcttggagtctgggtctaggtcgttgaacttgtgagacccaaagaagggtgtttccagagcatccggcaggtccatcaaggaggcatttccagttctagagagggcgcacattggatactgcagggtcagacattgcggatgttctctggtctgtaataacatactcgcaagcgcaagcacaggcacaaaaaacaacaaaacggcctcgcacagtgggggagcaaaaaacaggggaaaaaaatgcgtagtgagtgcttacctctcatacatatccttcgacttgatgaggtcccagacttgaggatgagtccggaaagcttcgtaaagtacgtcggctccactgtgttctgcgcccgcaatcatgaagctcggcacaatctttttgcagatctgccagtgacgcccgttcctgcatgctggtgggaagtagacggtggtgctgcgctctctcttgaccagacgcttgggcaacatgtcgacgttctcgctccgatcatcctctagggctgttgccaaggactttatcctgaccttgcccttgaactggagactgtgggcatatcgctccatcatgatacgctctgcatcctgtggatcggcatcaaggattccttgaaacagattctttgacggcaggcgtacgatgaacacaaggcatatggacaggaagcagcacacaagagcgatccttcgcatgcgcggcatgatgaattttcgcctgtgagatgtgctgagggcttttttttcttgttttgtctgaaaagagatggagtggaattcaggagggggttaataatgagaatgagagagggagacgagaggagggaggcgggagagtaagcgaccagaggctaggccagtgctcatgagccggatggaatatgctcgttgttgtatgtgagtgagtggggtgatgatgagaacgtccaactgtcaataaaagaaacgaagagaaagcgagagagggagagggagtgggatgcacagagtgtcggtgcgatgcaggtaataaagtcggatggctgtcgggtgcagagggagggataaagattatgaggtgctgagggaagcagtgcacagagagtgcgttgtgtgtgaagagtgagagacagtgcgctttgtgcgggtgagttggggcatacctgaagaggggacaaggatgaagcagggctgtccgttggaagcaagtgtgaaccgggacaagcacaagcggactgggcggacaggcgggacaggcagaggccaagtgaagagggtgggtgtgtggaccagcagccgaacaaacagccgcagggaaaggaaaagaggttgggcagtaaagaggtggacgcagccagagagtgagagagagagagcgagagcgagagggtgccaccagcaggggactagtgccgggtgaggttgctggcagatggtaccgtggtgcaaaccaagtgcttcctgcagggtgctgttgtggagaggcaagtgtccggaaagtcaaccctcagagtggttcaagaacaaactgaatgtcggatgggagttttgcaggccgccttcatgcggcctgccagagggtgacgtcagtgcaaccttcagaaagtggctcacttctcgcctaaatcccatttcccggtcactgttcgttcattcacgtcccgcctaaattgtcctcctactctccgcaacaaagctctttgtccctactgccaataaacctactctcacaagcttcacatcacagtacacacttcattggctgtctttcgattacgctctaacctttacaaccatgggagttgtgggcctgtggccccttttcaaaaagaagggttatgagccagcattccgcagccatgtgccgctagacaggagcacgagcgaggcagcggcggtttgtcggctggacattcagggaacattctacatgaatataagaagcgcatacatccgccatcccgccgagattgcacatcagatcatggagcagcaaatatccaagatggttccaaaagaccgcaccgtcctctatctagatggcgctctcaagcaaaagagaaggaagcaacacacgcacagcgacgccagaatcgccagaattccgccagcgacgccgagaagctccttgttcaacttcgggatcgcattcagaaacgcgagagagtgcgaaagtggaggttcaacgccatccagaaggccacagagaaggtcttttattggtcggctgagtcccgggccgagttcgcccaatacctcgagcagaacggttggacggtccaggtcgcaccaacagaggcggatttagccatcgctcgtgattgcggtccagcggacattgtcataagcaaggatagcgacatggccatctacaagtccgtccatcgaatatgcaagccgatttctggaggtcgatctctggactacaagctacaggacgcggtggacgctcttgggttaactcggcaacaactctgtgtgctgggcattgtatcccgtaatgactacaaccggaacatcgcatctctcggcagcgcgaccaacttcaaattggtaaaagagatcgtggacacaggtaagcacgaggacaatatcatccatgtcgttccaataggttacacatcatgcttacactctgcaacgtttatttcctagatcctgcaacgatggtggaggactaccttgctctggatcaggtggtcttgaaaaacacaacaaatgagtcctttagaaatgccagacgggtgtttgtcgatcttgttcaagagccagtcgaaccatcacaagtggcatcggatcaggtgcataaggagctcagcaacgaactcgaggatctttgtgttcaatacgctcagtcaaagtcagaacgcccgcgtccgccaagcacaaggtacgagataaactgtttaacttcaaattgaagctccttcattaattttgaattctcgagtttggttttggttatattaacagcgtcatatcttcatcgacatgtcccgcttagcgagcccaagaatcaatctccagggggattcaacagataccgcacagtcgacaagcctccccctagacagaaattgaagaactggaaaccgcgatatagtcacaagaaacgggtcagatgcattgagcacagtccaccaaaggggatgacccgatatacctggaagccatacacgccgagaccgagcacggctgcaccggctgcaccgcaggagcccgaggagaacacttcggacgagactgcttcccagcgagcccctctaaaacctcttgacgaaatgaggaaagtcgacttgaagcgggcgatgttcagggagcaccctatatcgactctggagcttggaacagtgaaggcaaatgccacagcagccttacggcaccccccagcagacatgtcgacccttcaggttccctgggcggacgtggcttcagctgtggatcaatgcctcaaggatgttacaaaactcgcctccgacaccaagatatcctgccagctactagtaggccgttttgtggagcgtctcggtgctcaggatgtcatcagcagctcggacagggctcttcttgatttgatttgtccgcggatcccagtgaagggcacccaaggcggcgctggcctcagagcaagtaccaccgatacagtcgacgacgaaaccgaggagcagagcagccatgcacagttctttatgacactggcgacatatgtttactcgggctcgtgtctgtattcctcgacagccggccgccaagtggaaaactttatcaaccgtgctcatgaacttggtctatgtgaaaaagtcgataagcgctctatcaggagaatgatgccgtaccctgggtcatcattcctctgatctgttgggacgcaattggcgagtgagtacaaacggcatttcagccaaggaactttgaccatgcttgataaggtaacgatgctgtgtatttgtcgctttcgtcgccgtttaattacgcctttgtggttcgagcgccagagggactaactaccacatgtttctatataggcacataaattaaaggaacgccgaccagagtctactgtgcccgagatcaagaacaaccgctcggctgtggagaattttctgattttcaacaacgcaagcaagaagccgtggaagcttgcccccgtgtctccagcagagcatggtttcatacacctatccgaaattgacctggttgttatattctgcaagaacggtcttctcaaaaatgtcctattgagccttgttagaaccgacttccgcactgccacctctcaggacgacatcctgcagtggctaaaggacaaagagccagggtacttgatcagacggtttgtggcgcatctcggcagagacgaacaggatccaagcgcacccgcgatgcccaaatcgaaggaggagaggaggcgcttaaagagccacaagggtgctgttcgtcttctctcgctggacgagattcgtcaacatgtggggatcgttcgggactatgagaacctggacttgacaacgtaccacgaacgtggatatgttgcccacgggagcatcaaaaccgacggcttcagggtccagttgctagccttcaagcttaaggagttgcagtgtgcccggtacaagcgtcttccggagcatcggttgccacttcgactgaccagcactgtggccggagtggactacttcatgacggaaatacgcaacatcatcaagactgacgacgatgtaacaaggatctggaactgcaacggcgatgaaattaagatcctcgggattgatctcggacagactttcgtggtagggatgagcgccattcttccagatcaaggagaccaggagcagcagatcttctacaacttggctgcttcacagaaagcagtttaccagcccacgctaaagtttcgtcattggagcgagcaacaaaagcgagcaattccgccgggcagagaggagtctcttgctgacgttgagtcgagcctacctcctctttgtggccccgatgccgatttccagcaacatgcgagagcgttaggagagtgcggccagcagctggatactttttacaacggctcaaggcagcggtacaagcggcacagattcgatgcccagagagcgagaaacgaggagtttgcgcacctcacggaccaaatattgaggatggtcggcgggacgatcggagagcgacgagatcccgaaaacaaagttgctatcggaattggactgggccagttccagtcaagcagtggactatcttcgctccattcgtccttgagctatttcctgaccaaggtgcttctatgcgaggttcgcaagatatatgacatgtctattatcttcatagactaatgcgagtcttttttcgtttgtaatgtgttaggttcgcgccctgggatatgttgtgcttggtgttaatgagttttacagctccaaaaaatgcccagtctgcgaaaatttcgtttgccaggtgaccctgaggcggctgttctgtccgcactgtcgagtatatctccacagggacgttcttggcggccacaacctcgcgaacattgtccaggaatacgtactccatcagcgaaggcctctatacctccagccgatcacggaggacggggaacatccctgggaacccgccacgcccgcgccagtctagcttagtttttttgtgtgacaagtaacacaccgcaagtgaggaaggtggctcggaagccgagatttcgtcttcggtgacgtaatttaggcgaaaaccgagccatttccaaccttcaagcgcaaagcccattgccactcagcgtcgttcatagaacaaattgctgacagaccgctcagtcgtcaggcccaagtttgccgcgcaatcctttggagacctcataaatatccctctgtctcctctcttctcgagtccgctctaccaccatcaccactctcgccggcgcacacgcacacacacacacacacacacacactctctctctctctctctctcattctctctcattctcccctactcccactcacagcccagacacaatggagcttccatccatcggcaaacactgctccgactcgacctgttcacaactcgactttctgccattctcctgtcagtactgcaaacagatcttttggtaaaaaccaaccttcacttctctctcacgtttgtaaaacccagattacaacgcatcctccaactcaccactttttgtcttctctctcaccttttttttctccatgttagccaggaccactggaggctggaaggtcatgtctgtccgaaacgagacgaggccacacagcaggaccaacgggtgcccatctgtcccctctgcagcaaacccgtccccgtcaagaagggcgaagaccccaacctacgcatggaacaacacatctctgctggatgtcctgaacccgccaccaccacctccaaacccatctacacaaactcttgccacttcaaggcatgcaagaaccgttcagccatacccatcatctgtcaaaagtgtcgtctgaactactgtctgaagcatagactcgaaggtgaccatgcctgtgccagcctgcagtccaccaccaccactcagaagaaaggaaacaacggaaacaacaacccgggaacgagcaacctaaacggaacgaatggcaagaataataaccatgcgaacgccagcggcactggccaccactggtcgttgaagaatgccaatgccgcacggaatgcaagggctgcagccgcggcgcagcaaagggccaatgcttcctcctcatcatctgcagggaaaaaggacaaggacaagtgcgtcgtgtcatagaacattcacgttggagcgtcaatagaaaggcagtgcgccaattagaattcagctccccctgttcctgtccctcttctctgttcctgcagtggcattaatgttgtatgggtgacacaaaaggtcaaaaaaaacagttgggtgtttatttcacgttcaggactccattacgccttgcctgcagtgtcgattgccatgagtgaaccgataaaggtcaaaatctataaagaaaaaacaagggggaggcaagtgcaaggcaaacaaaatacgagtgagcgatggacctggtaaatgacctttgtaaaagcatacatcatagcgaagagagcaaaaacaagaaacagcatatgcaagaaacttacaagtttagcgcggcattcaatgatatcctcgggcaaaacaaagatgacggcgccaatctttcttgcgaccgagatggcgtacttggcgttcagcttggcatcctctaggctgctgccgcggttcaccatcgcatagtcgacgctcccagggcggacaccattgagaacatcgcacacaaagactcctgttctgaacgaaggatccttgaagctgctgaccttgctcgtcttgccaccacgctgcacagtttcgttggcccagcggatcatctccatatctgtgatgtccctgcctgactttgagagcttcttcatcgtctgggtgacattctcacgcatcatctgccagacaagacccagcgtgagtgtggggctgccatcgacgatatcggctccctgcatgttgaccaatgtgtaccgaaggtgctgaccgatcatgatcgcgtagttggtgttttcgacctgcttgaagcggttcaggggtagacggcggctgacgcgcttccagtctacgatgccagggtgcatcttgtcgaacgcctgcaaaagaattgttccatcctgaagatccacgtacaagttgttgacgaacgggtcgacatccaagctgttgagccagagagcaaagactaatcaacaacagagcaatgagcgactctattagctttctccatctcactccacgaaaaaaacaaggccaagaaacgtgagcgcaaaaatgcaaagaaagcaagcgtgctttacctctagcttcgcgatcaccctcaacatcaggcagctcagggcgctcgacctcctccagtggatcgaggccaggatgagtgttgaaaaggttggcaacaaaggccaggttcagtttggggttaccggcgacaagcgattgaggggacagatacttgcggcagttgagcttttccgcattctggaggacttgctccgcccgcgagaagaggtcattctctcgaagaggcgcccgtgaacagagatccggtgccagctggttgagcaaaacagtgtagttttcgccatccttgacgtccgagctaaagttgttgacactgcatgtgggacaagagcaggggcagtcgaggcatgaaaagtcgaagagtaagcggatagacacaaatagattttctcattctgcagcttgttcagtttggctctcagtaacagtcggaagcgaaagagaacaatgggacttacgtgcggtgccatccagcagccttgaggtgataattgaaccatctcaacagaatctgctctgggggaaggcggagaaacttttccagcgactcgtcctcctccaacaagcggtacagttcggggtggagtcgaatgtcaatcttggagagcaaaccggccttgatgatctgccagataagtcccaggatcaagtgctcacgtccatccatgatgtcctgaggtccaatattcacgacactgcatccaatagccttggccgagttgatggccacattgttgttctcgatgatctgaaagttggacagcttgttcttcacgttcagcacacgctcgtcgatggtgtcgggcacagagtcgttgatcaacttgcaaagcagcagaccatctacaggaacatcatcaaggccaaaagaaggggccgaacagtcagaattttgtcacctggctttcccaaaagtctaatcctgctggcgtttcatgatgtttctgttgtgtccatcagaacgtacctcggcactcgtcaaagacctgcattgtgtgggtggggatgggaatacggtcgccgatatgctggtcgcccgccagcaccgagttgatgtgcgcagtaaactcggagcgttcgtcatcattcatcgagtgagtgatattctgattggcacccttgacctgaatcaccttcttgccggacgtggggttgctggcaccaccctcacgcagcttggacacaatctgttggacaggacgatattttcgcgcgcaaaagagacaagagaaagacgattcgatcagcaacatacacagtagacgttgaactatgtcatccatccacctttgcagtaacgtctgtggccggtggacagaccacgcggtgtctctatccccgtttttttttatatcttcctgcaatacaacgagcgcgtgagagatgaagatggcgggaataaagtggtcttacctcaagaaactcatcgacctccaccttgccggtggcattgatgtcaacagccttgatggtcgcgcgaatctggtcgtaggattgaccctcgccaatctcttgaatgacttttaccaggtccttttgatcaatttggccgcgtccatccacgtcgaaacggctagagtcaatccacaagaaccgagacgaaagcgaaggcaaggtgatgagtaacgtacgaaaggctctggcgcgaacacgctgacaagcatcaacattcatgtgccgaggggcatctcactccgttcctcaacacaaaacgagcgttgcacggaagcagtcaaaagaaggagcgtcgaggacgagcgagtccgtggctgtccaactcacctgaactggtccacgaggttgtcgacatcgatgacggtcagttgaggaaactttttggcgagctgcgccgagttgatgacaaccattgggtctgtcttttttggcggcagtgaggaatgtgggaagattgtactgaggtatgcgaaaaggaatagaagagagacaagtgtcgcttttgcgaagtggcgggctgaggaagtcccgtatgacgtttttttttttttttgggcccaattgcagacgatcgtcgttgtagtcactgcgagtcggctaatactttcactcaagcccaaaaaacgacacacacctcacgagagacagagggttgagatgggcaaagtacacagaggtcttgctttggcacaaaagagactgcacgctggtcaagacgatcattcttcaagtgatgttgagtcgtggcctgaacggctcttgcagggatagatccaacgcttcccccctccaccccctagcctttcagtcttgaaacgcagtagacagctcatacttgcaatgttgtccgtaacacgagctcctcatcgtcatggcgccctgtatcgtagccaggtggaaggcgaggtcacagggttcatcaggtagagtcgatgcggtgcaggagcatgacgatgactgtggaggatatagcggctgcctagtagcgagcaacgacgcgcccatagttgacgtgcatcggtaccaaaacaaaactacgcgacataactagcttgtgtaccgttgccgaggatccaacgccaaagagcgtgttttcagcacgaggcccagatatgatgatcctctatctcaatttgcagatgaattgctatagcaaatcccatgtacctttttttttcgccatgtccatcgaagggactggtcttcgtcgaaaagtacaacgccattaaaaaaaaactttgttgaaaggtctagtccttcatcaccagcccatgcggcatagatgacatggttcttctcataaagataagtctttgaccgcgaaacagctatccttaagataatgaagcaaattgcacctccttccacaacagagagagcctagttgtatccccccctctgtgttctcatatcagagttacactcgtccactacaaaaattcatttcacctggcgcaatttacaattattagctagctcagagaaggcgcgtgtgagagtggcccccaccccctcctcttcttcactcgtcgttcaccctccctctccacagtaccacggtggcatggattgtctcatgacaatgggattgtgtcctctccaacgggttcccgtgctctatcgtcaatgagccgtgcataatctctcgatgcaaacaaaagatctgtcctccgatcatagaaccaaacgttcaccagacaacgaacttcttgataaaaaaaaaaacgtataaaacctctccctttggccacctccaatgcccttccttcgatatcatctacctcatacattctctactagacatcttcatacaaaaaataacattactgtcctaatcctcccatcatgacctccaccaactcctcctccaccaggctggtcctgatggccttcctcgtcctcgcgatcgtcagcctccaggacaccctcgtccaggcccactcatggctcgactgctccaacaccctcgcctccggacaatgcgccggctaccccatcggcttccccacccgagccaaccccgacatcaacaccctctacacctacctcatctccggtcgcaaccaaaacgccgccgtctgccagcccggccgtcaggacatcttccccggtcgcaaccccgcgaacctgcccccagcctccgtcgttcccggccaaaccctcaagctcacctggcaggccaacggccacatggacaacgtccagcccggcgacaagaacacgccccgatcccagctctttgtctactggaccggtcgtgccaacaagctcttgaagactcgttcggagctgggccgaccgggcacgttgctggcccagatggatttcgccacccctgccaactgtgaccagccttcgaacccgaactcgaactgccatggaaagatcaagatccccaagggcacgaagccaggtcgttaccagttggtgtggtggtggaagtttgacaagaacccggtcggtgaggagtactcgacttgctttgaggtgattgtcaagtctcctcccaagcagaagagacagatcgagcatgcctaagcgctttacttttgcgagagtgaatgttaggaggagggtgaaagggagggaaggtgaagggaggaagtgaagggtcatttttttttttggcagcggcaaaagagtttcatttcgctgctgatcttttggcccttccctctcttcctcccctgccaccctctgccgtctccccttgtccgtttgaacagcttagcttaacatagccaaacatcgtaaatcagatcaaaaactacattccacttctcgctttctataacgtgccgacgtagtggtcaagtgggggtgggtgtctgcaaaaggtgtgtaacatgtataggcagtgtagtgaaaaacacgttgttgggcgatcgaaagaaccagttggtcccccttttgagtttccacgttccaggcccccgtcaacctatgagatgcctgggatctcaaaagcgccctctcattgggtgatcctctcactcaagtattcttttttttttgcagctcagcggagaggttgtatgaactgcagagctttggtgtccacttgatccatggcgaagacagaaagaaaaacgaaggagcagaaagcacaacaccactgaatgctatcgtggacaaatgagaaaagaatacaatccagatccgcatggatagcccacaacactgaaacgaaagtgggtgttggggggattgagaccaaggacagagtcgatcaacgagaccgcaacccgtcaatcaatacccacacgcacacagacacagacacagacatagacacaggcacgcaagcagggcgaggaaggagaaacaaataaggacatgagggagagaaaaaagactctggatttcctagatccaactcaaaggcgaccaacagctcatccctgcttgccttctaaaaagcacacacgcacatacacatacacatacgaatatatatccagatttgttttttctcacgcaaaaacgtggtcaacattttcgtttcgaccttccttcttcgcacacaagctttttacaacgaattacttatattttattactgaggagatgaaaaccactgggatgaggggatatgtattacgaatgacgagttgagtcgagagagagggagaagaagtagatggtccttgatttctttttttttttttccttacagaacgtgctcaccacggagcttcttctcagacttctgcatgatcttcaagaactcctcgagggtgatacggccatcgccagagacatcggcctcgtggataatctcgtcaacgtcagcctattgttccaaaaaaaaaataaaaataaaaaaaaaggatcgagcagtgagttaactcttgttccgattcagccttacaattgaaaaaaacttgggcgacttcaaaagtaggatgatgagaggcagagagcgtcttttttacctcagagagagagttgttgccaaagtgctggagggcaccacggagctcagcagaggagacgttgccagaaccgtccttgttgatgttgttgaaaagagcaccgtaggcctcatcagaggtctcggctcccttgtggttcttggccatcaaggcagcaaaggccttgaagtccaagggctgggtggggagcttgacgttcttggtcaactcggggtcgttgagaagctaatgaagagttaacaaaaatcaccacagcaccaaaaaaaaaaagagatattccggttagagagatggagtcgcacagacttgaaagagggaagggtatgtttgcgtgtgggtgcagcagtaataatagtgttgtcgtcaacaaaagacgacaagaaagcagatcccaacatctccctatcgtccaaggtggagataaagagtcgtttttccatagtctttcttggtgctgttgatctacggccgttttatcttgctgaagtcgtgcaagtaggagcataccaagaaaaaaaaacacagtgtgctaggttcattcgaaagggggaatggcttgcgatttcagcagccgcgagcagagatgctgaacgggagcgagggtgggcgagcacggacaggagcaacaacgcagagctgagcagggcagaggtcggttactaacagcgataaagtcggcgaaggccttgggctggatggtgccagagttggtggggtcgaagagggcaaaagcctccttgtactcgatttcctggccgtgggagagagacatgatgaaagagagagagagagtgtgtgtgtgtgtggggtggggtggaatgaaggaaagggatggatgggtgaaggaaggaaggaaggaaagaaaggaaaaaagaagagggcgagaacactggggagacagctgcccttttctgtttggtccgtctggggaacaagggcaggcaggcaggcaggcaggcacgtacaccctcacgtatggcagatcatctcaaccactctcacttttgcacctttaatctaccttaattgacttaccctactttttcgtgcagtgttacccaggtactgtatttgacgctcgactcgactggaggggggtgccagcagtgggtccgcctctgactgctggagctgagatccattctgcccgtgagggccacagctgcagcactgtcactattggccgccccgttccaggggcggacgggggaaaataattgccggcgggggtggtgccagagtcgttgtatttttttttgcggccttttgatttgaagtttggctctcacgcttgcatccagagatgtatatacctcgtccctctatctctactcgctctctcactccctccctcactcactcgcccatttcacctccagtgaggtatgaggtattttttgatttcatttagccgtttgtcacaaactgcgctcaccgcgatggttgttctcccttcggtagtacgagatggggtcttggtttttgaacatatcttgcagaagagtcgataaagagaccacaatgaccttcacagtttacacccacacaacacatacgcaagtctgcatgctgcctgcatcagttgcacaggacactcattctgagtgtgggaaatgaatgaaaacactgagggcatagagggctgcaaagaggcaacagcaaggtatcggtcttcacaatcggaacaactgtccccgcattttttttttcactctgtcctgctgtcctgtgtgcagacatgttgccatcgatgcgaccctgcgatccctccgatgctttttttccgtcccctgcagattaaagttcattacaggtatcatatatgtatttgaacatgtaccgtgtgtaaaaaaaaatgctgtaggcaagagacaaaaaccgataatacactgtctaaaacgtggccgcgcccttgggcaggcggatgccatcccagctgagctcgtactcctcccacaccgaccacccgagctcgcgcagcagatcgcgacggatgcccagcgcacccttgatctggctcgctccttcgcggcttccaccgccctgctcgctcagccagctgttgacgcgctggagggccaggcccaaacggccttgcttgcgctcgcgctccagatacactccaacggacttccagtcgctcactcccgtgccttcgctccactggctcaggttgttgtaggcctcgtccgagtcctgcttcagcgccaccaaggccacgcagcgagccttgagagcggcaatcaaggcgttcttggcctcctccttctccttcctgaccttcttctgctccgcctcggccttgccgtgcacagtcaccggcttcagtccaaagaatcgcgcaagctcagcctggtcaatcgccttggtgatcttgtccgccacagcaaggacattcttccacttttcgtccttgattgaatcctctgcattctcggccaaggccagagccacatccagctgagccaacataacgggcaggtgctgtccatgtcctgcagcctccagctgatcaatcaattcctttcgggtcgctgcagctgcctccttgtccttctcggtcttgtacgccgtagcgctcttcttgagccaagcaacctgagcatccctgacctgctcagccaactgctgggccacattgacctcctcctcgagctcggccgtctcttccttgatcggaatctgctcgggcgcaaccgcatagaccacacgcgtcagaggactgccgtcgatcttgggtccaccccacttccactctcccaccaaaaagtcgccgggcttggctcccttagggtgttccgaggacgagaccacaaacgcagccttggtgtctccacgctccaacacactggcaaacgcattcttcttgctcaccaaggcatcaggccagaagccagacacctcgagcgactgcgacttggccagactaaagtcaaagagaccaggcaaatgacggagcttctccaaggtctcctcgctctcatggcggagctggagacgcagagtgtactcgcccttgggcagcttcagcttcttgacatagacgtcgccatagccaaccaccttgttgttgacatccgacacgatcatgagcacctccagaggcgaatcgtacaaaaggtcgttcagacttgggaaccggggcgacacggtgacagactccttgcccgaggcctcgaccttgaagggataggtcgagatcagactgtacatgagccgcgagttgggcaagctgtcgcggtcgcgaaccaagggcttgatcgaactctcggagggacgaatcaccttgcggagcgcatccaaggaaatgctgggcgacaagccctcctcacgacgaacaggggccgagacatggaagcgagtgatgtgatcagcagcattgatgaagacagtgcgcggtccactggtgggtccagcgatctggatgccatggaatgtcaagtcgactgtcacagagtgggcaccagggctgtcccagtattgagccaggcacagctccatggtgtggttgctgtgcacagcaaagcgcttggtctcgcactgctcctcggctccaacctccgcatagctgccctttccgaggcggatcatgtagccctggttggtgtgatcgttgcgcaactgagggagcagctgagcgacatagaccacaaacttggcagccagttgtgcgacactgccattgctcgagctacggataacagcctcagcatgggtcgcaccggcaggaacacggatcaagcggcgctcaatgtggccaggcccgaactgcacattctcaaacttgatgtaggactgggtggtcaactcgataggcttggcgacagtgacatagatgctgaaaacgggaccgcgggcggggcaggaggagtcaaaggcctgaatctcggcaaaatggaccaatccagccgtgagctgagtggggtcgaccttgacctcgaactgacggagggcgccgttcataaacaggaattctgggacgcggatccagctgtcggtggcaacgagggccattctgcactcgaacgcaagcttcttctcgttgatgtcgggcttgttgtagtcaacgtccttcataaacttgggctcaaccttcacggtcagggtgtgggccttgttgcactcctcccactctctcaaatagatgccacgggcattgtcacgctctgcaatctggatcttgtagtcgacatcctgctcctcataagcatggtaagtcagcaagtgatcaaaggtcttctccacctgcagaaatccaacgcgaaattgatcctgaatgtccttggaggcattgacgagcgcgcggtggacgcggtagggggtataggccttgttttcggcctttagtccagagagaatgagcgaaatgcatccacatgcattgggggaactcatggacgttccgttcatgcgctggaactttgaaagctcatactcggggatcgaggtaatggcagcaccgggggcatagatgtcaacacctacatcaccatcaacagcgggtccgcgggaagaccaggtgtagggtcgctcggggacagcctcaaagagggcatactcggcctgctgcatcgcttggctttgataggctccgacgctgacgattccagaggaggtaccgccaggggaaccgacggtgcttaacgcaggaccggcattgccggcagaggaaacaaagatgcatccatgacgaccgacagcttcctcgcgaatcagctccacaaagcggccgatgttggggtagcttgaggcctctccataggacatgttggcaagatcgcacttgtcgtcgatgatgaccttgacggcacgagtgagagcgtggtgcgtctcgatgcttcccaaacgagaatcgccaatcttgatggacacaatctgggcaccgggagcaacaccgttcaaagcgggctcatcgggatggttggcggcagtaatcgctgcgacgtgggtgccatgggacccagcgatgaccacgatgctgagcatgttaccgtcatcgtagatgttgacgctgtagttgcacttgtcctggttgctgaaggttgcatactggcgctccttcttgaaatcagtgagcagaggtgcatctgcgttgtgacataaaggtaaaaaaagaggtgtgtggggagaggttagtcagaaatgaatgtcaactagaggccgatgcggttgtcattgctgtgttggatgctcctggcttgcgtacctgtaagatcaccgtcctcctttgcatcgacggccgcacgccagacgttgccgtcatggaagacaacgcaatcgtaaatgggacctgggtcagaaaagtttttgatcgactccttgagcacatccaggcgggcgttgaagtcggcctttgtacgctggtcctcctcagtcagggtgctgtggttcttgaggaaggcagcgagctcatcctggacactggcgacgagagcaaagtgcttcttttggaactcggccagacgttcctacagtgagtgtaaacgacaggcgcgtcagcatgcttcgcactggttcgcaagaatagacgcagagacagctacccctcaaattctgtccccaattttgctcccacgcctgttcgtgccctttgcgggatgctttaccttcttgatgcggtccacaaggtcctcggggaagaggtcgtacgcgcgcttaattccaaggcggtattcgcctgaggggttcttccagtccttgctcaggtgcagcttgcggccagtgaggccagtgatgacagggacgccgtccttgttgtctgtgggcttgacgatggttgtggtggggatgtcgcccgagccggagcagtcgacaatatcaatcaccttgggcttgccgtcggacgtgacctggagtccggctgcgcctgggtcgacacccgtgtcgaggatggcgatgatggtgttgcgtccgtcatagttggggtatttcttcaagtaagcagcggcttcagtttcctatagaaaggcaaaggcaaagacaaaggtaaaggcatggaacccgagcattagtttcttctttcttgtgtattcttcattcattaaaaagctcattcgttcgctcggaagcaaggtggacgtgctaggcacacgcgattacctccttgggaaggatgccctggagagggaattctgggatggggcggatggtcttgagggcggtcatggggcgaatgcgacggcgtgagggtatttacaagagggggcgggatggtggcgcaaggaatgagggcttggcggaggtgaggcggggacgagggacaggcgggacaggtggaggcaggcgtgcgtgtgtgtgagcgtgtgtgtatagagggtgggtgaagggttgagtagtcaaaagaaaaggaaagacgagaaggaaaggaagaaaagaaaagagaagacgacggtggcgagcgccttttttaatcagcccagtcgcacggtctgactcgaccgaggtacgcgtgtgcgcttgaaggcgtggtcaaaatggtctccaaatcaggaaggcctcgcaaaggttatttgcatccttcctacacacacacacacaagcacactcgctctctctcagtctcgctctcgactctcactctgcggtgcctgcatctgcatgtgccccgctcctgctgctccagtccccaacagagccaagggccgagctcccaaggcatcgtttcgtggtcgacctgcgtggtccatctctccatcctccgctgactcgttggatcaagcatgccctcctaacccgctgttctctgacccagatagcgatgaggaatcggccgaaaagacgacgccattcggcagctgccgtctgtatgaggggaccatccaagacgggatcccctttggctgtgggccattcatcgccaggctctctttcccacgaaagtgctgcgcgctgattggcccttggagcccatcctcatcatcagcaaacttttttttttctgtgttccttgccgcttttgtcctctctccatgaccccctttgcctccaatagctgtaggtagagtgaggccaacacttgcgatacatgtcgcaagtacagtggaaaaagacgggccgtactgctcttgtccgccctcatcctctccttcttcctcactgaggcaacgtcgccctcggccacattcaacgcagaagcaggcgccccttgacccatgctgccgatgcggttgaaagagagtgcagcatcaggacatgttaaagtgcgtgcgtacgtgaattcatgtggctgtaaagcatagatgagaccgttgacagatacccgctacaatgtttgacgtccaataaagcgtattcagccttgactgcaagatgtagcagaggtgatgggtcctggaagtgagcaggcaaagaggcgagagtcgaggagggagtattttggtggatagggtctggaaatggaatgagtaccctgcactggatctcaggatctgctcaagccgtggaatgctatttaatccgcccagatctgccctggcagtcagcagtaaagcttctctgcggtgagggtggtacgaatggtatcgagctaagcgagttgaaccgaaagtcagtggctgcagtaactgaacagggatcatctggtgcactctatcgaaaaaaacccatcaccaattcactctcacacccctaagaacacaccactgggatatacatccgaccaatggcaagagatgcacgatctgtgcttgctgaccgttgtagatttgtcaatgatcgcctaccatgaccagccatcctcttgaaaggcgcccgttgatgcagctcctccgtattcgggagcacgccagcgtcgagtctgtcaccaccgttgtttccctctttccacgatcgtcatgcggtggttgatggaatatcatccaggccctgaaagagtaggttacggatcgtcgctgcgggtatggtcttgaagggctgttttccttttcactgcgttcaacctgcatgcagcggcaatagactgtcagccatctttgcaaaatgggtgtgtgtgcaagtgcattaggcgagacggctgcgcttcgttttgcagcgagtggcacgcgctcggccctctgttgattggtcctttcgagggcaccagcgagatcagggttggcccgtgggattcggatagggcgttcgaataggaaatagggagagcgagaagagaagggagagaagagaaagaagagaagggagagaagagagagaagagagagagatagagagcaggatagcggtaaggagggacgggatgaaaaagcgcgattgcgagcacagagagctggtatgccatcatggatgggcccgttgatctgcgataacggaattggctgtgagggtctggcgtctcttccttttgttgtatgaccttggctatcccccctcaccctacctccgcagatgcaggtgagcgcaatgtggatgtgcatgatattagcctgagcctatgtcggtgcgatagactctccaccaatgctgggcagggttctctctctgtggtctattcgacatatctatgatgaaaacaagaaggcactaaggccacaacaagaaagagaacaaagtgatctagtggaatgggtgttgatgcttcttgcgtcggtgtgtgtccgttgtttccacctgctccagcccatctcctggccaccccttgactgatgtcccaaacactcacccactctgcactgctctgctctcttctgtctctcttgactctctggtctctttttttctttttttctttttcctttcattattgtctatcttgcatattgagagagacaagaggctatttcccccctcccactccccgtccactctccactctccaccactccactccaccaccttttttttttccatttactctcttttactctctcactcactctcactcactctctcactctctcactcactcactcactctctcactcactctcccactccacctgcttgtgctggaaggacaggctcgtgcaccactgactcgacgcagtgctccgcttccctttcctgcgcgctctctctccgactctttactccttggacaacactccattacttcattgcgacaccactcctgcacacacacacatccactctctctctctcacacacacgctcacacacagacacacactcgactgtcgcttctcgcatcactagcagagtcgtcgcccgaccatgaacatcccgcaggacaagctcaagacaaagcgctcgtctcccctgaaccccaactcctcgtcgtccagcatcctgcctgccgacatctccaccatcacctccgcatccaccccatcctcgccctcgccccttcagcatgagctggagcgtgcaggtaaatcgttgctcttgttgttgcattgttatcttgttgctgttatctaattaggctaggtctgttttccgttgttatgcgcctgtgtttgttactggtctcgcagtcgctaaccgtcctctccttctttgccgcactcatccagacaaagcagacaccagacctgcaggagcgcgggacagcccctcagtaacgctctcccctgctacaccgtctgcagagagcgcagaggagcgttcaccagagcaaaacaccgttggcactgtcgacaaaccatataccaccagcgcgacggacgaaaggcaacgggaacgaggacggacagtcgccgctccagtgcgggacaggattctcatgcccaatcgatcctccatcaccatcggcatcgccaacagccaaggcgtcggcagcagcagctggagcacaggcagctccagtctatcccgcctgcactcgctccaccagtcagactcgatgcagggcagcagcagtagcctcgtcaacaggaccaccgccagccgcgactcgtcgcccaagccggggcgactctcgtctccgcctaccgctgctgccgcgatccccacgcgtcgcaagagctcgttcgacaaccttggatcgagctccagcacatcctctgcagcatcatcgtttgagtccggcagaatcctgagaaagccatcggatcagtttggctcatcctaccagctgatgcatccgcacgcacactctcagctccaagggcaaggcttgagccagcaggcctcgagctaccatcaccaccatctgcagcatcacagcagcagcttaagcgtctcgggaatagcatctggatccgtatcatcaggagcagagtctggaagcagcagcacaaagttcaaaagcatcccgatcccgcaaccactcctcacccgtcgctccagtcgatcctccatctcttcaaacgactcggatgacgtctcccacccacagtcgcaccattacaggagcatgagcaacacgctgccgatcccagagtccccgcgggctggttttcatccgagagggaccagctccagtcggcgaccctccaatctcgccacgtccatgtcgaacagcctcagtgactgggaccaaggtccttctttcatgtcaaagccatcccctggcggtggagtcagcccaagcacatccggcttgagtagtagcgtcggtggtggaggcgctagcagcggcagcggcagtggcaatttgaatgcaggtggcaccgggagcactgctggtgcaggaagcggcggcaaatatctcatccgttccaggaggacctcgtggatcgatgctggcggtcattcagaatttggatcgacaccctcatcccccaaggctatcggaagggtcacgagatctcgaagggcgtctatcaccgatgagttgtccttggacgactggtctccaacgcgaagagcctcgccgtcactaaacacgtattccacctccattcccacaggatcattctcacaatacatggctatggaaaggaaggccagatcaggatcgccccacacaggacagagcatcgcatccctcatggagatcgcgtcgttaaacaatccctttgaaaacctaagaagtccagcctcaagcgacacggtccgggatagaaactcggacaaggacagggatacaccctcgccctctgtctcccgcagctcgtccgtgtcgggacggtatctcgtaaagtctagaaaggcatcctatatggacatgaacatggcaaccgagcacgatccaccagcagcacaaccttccacaggacaatcgctcttggccgcaggcggtaggacaccgttgttggcacggtcgcccaacatctcgccaaaggggtccccgaaaggttcccccaaaatatcgccgttagtgcgatcgtcagcctctagcccccttgcaggacccgccctctctggagtattcatctctggaaaaccatcgcctgtgttgtcttcgccaggagtgaagcttggccacagtagacaggcttccatcactgatgtggacgcacatgagcgaaggctgcggcgacaggttggcagccgctttcactacgaatcgggatttcagcccgccgtgcaagacgatgcaaccaaggacaatgatgtggacgtcgaggatctatctctagatgcaccaaaggcggtcgtgaatctcggcaagagccacatgacgaaaagttctggattcggtctggatcaactggccgctcagtttgcagagacacgcagcagcgataacaacacgtcagtgcctgaattgcctcactccaattacctggactctgtagactttgttaacgcatgtaagtctcattggcattcacatttctctctcatatggatccttggtttcgattgatctggtcgcctgactgactcttcgtcctgtattttatgacctcacttcagtcaaagctcatgggacagccaagatacccgatccaactcaggcaaagtccatcaggaggcgctctgtggattctatcgatccatccatgctccacgcggagatcattgctcaaactaggcgagccaagctcgagaagtggagaccggatctggatcagccaatcaaggaaagtccttcagagtccgcgtccacagccggtgataccaaggacgaggcatgccgagagcaaggaagggtggtctggatcgattggcttgaagagtaccaggcagagaagaaggctcgtctaaggagtctcaaggaccagtcgctttcgccaacactgtcactgtcggtctcaccgccgtctcgtgaaccagcgctgcagggagactttagacgttctggacagcccggcgtttcgcccgtttacccctccgcctcgcaatcgcttgcgcctgctggacgcaaatcgagacaaccccagcaaggacttttgcgcatcaactcgagatcgccctcgggcgtttccgactcgagtcaaaagagtcagcagtcactcaaaactggacttggaccaaagctcgtcaactggtggaagtcagtacgcagaaagtcaatgtcgttggtccagccaaagaaggccatcgaccctccctctatgatcggcgatctgtccaagggaaagagcaaagcgcaacagcaacaacagcaacaacaacaacaaccacaacaacaacagcagcaacagcaacaacagcaacagcaacagcaattgcgcgaactaccaacgcctcatgaagaatcgcccatctccgcatctgcctctccgcctcacccgctcaaagagtcttttgtgtcgcactctctgtttgagaagccaggtacaggctccaagccaggatctctggtgttaacaacagctttgaacactgcagactctacaagtcctaccagcaaatccagtggacaaaagtcatcgccgcgcgaaaagccaggactttcaatccaggtcaacgcatctcctccagttgtcagacgcgggtctgtgatggtcagaacatcatccttttctgccggtatcaactctgccaatggcgtggagggaagtcctttgcaggctggcccagagaggtcgacgaaaacgatccgcagcatgctggagcaatacaaggcagactgtgacgaggagatgcggaaaatcattgacggcctcaacgagtacgtggaaaagggtctgaactatgtggaggacattgacaacatgccggattttagcgctcaacagctggaccagaatgaggtcgaggagattgagggttggatcgagaacagtcaaatggagatggaggaagaagccgccagccatcgtctcgtcgaggacaaggatttcgatagtgccaatgagcgcgatatctttgaggacgacaggactccgcgatccgactaccctagcggtctccaggaatttggcgaagggtactttccagaagcctcagacggggaatcacctttgagtgaggagcccaaggcgcgatccatgcgggactcgggcgagtggtcgccctcaccttcttggaatggcggcagcatccctctgcaccgcaagatgactcgggagagccagcagcgatcccagtctcgagtctcttcccttactcgtcgtcatggttccaactctgcatactctccaggaacacccgtcatatcctcgcccagcgccaacgtcactctcatctcagaggactcttatcagccaacgccgtttattctgactctacaggagctgattgctgttgcgcagttgatgctggacacgccactaaagacgattttggacaacaagggcgcgtgtaccaattttgtgaccaaacttcaggtcattggacgcgcgtgggaccttaacaggaactggccctgtcggacatggtatgtgaaggcccttctagctgtagcgggcctcgcgcgtgttgtgcagtggtgggaggccgagcgcaaccactggatgcagagcgcaaacattgcagtcaaatcaaaagatgcatctcgaccctcaagcgtctacctcgggagccaaggagtctctggtcaatcactcaaccttacacttggacaggacaccaagtcgacccatagagattcatcagcgggcgcagaaacattggacgacggcccgagacgttcccttgatcagcgctcaaccagcgattcggacttgccgagcgtggccaaagttcatggcgtacaagatgtgcatgccgagcccggggatggagacgacgcagccgatgtcgacattgatggtctagtggacattctggaaaaggatgccgatatgcagtcgcgcctgacaaaggaggacattctgcagctcaagcgggaggctgagaagggccagagcaagaacgttgtgatggagctcagtctggacattgatgagatcttgatactgtacctcagcccaagctggtccgaactcttggggtaagtgattttctttttttagagcgacggcactactttgggcgcgggcgcaggcaaggtgggtccaacagatgtttcttgtggatatctaatcgctttgtcgtctactcctgaaaccgccatagatctgattggcaggagctcatggacacgccgatatgcacgtttttgaccgaggaagaggtcaacgtctttcgagacgccaccgtgcggttactggaggatgatcgatcgacgctggagctgacgttccatatactgtccgactacaatccgccttcgccctttgacgacactagctctagccagtccgagctgttcacctatgtccaagggatcaaccacctgggcgagtcgggacagtttctcaaaatgatcgggcgaggaatgctgatttatgaccggacgacgtgtgagccagttcgtaccatgtgggcgatccagccatacatcgggccagatgagaacacacactcgtcctcgaactcggtcatgtcggccctttcggaaaaatcgcaggaggacgctgatcagagccagagcggagatgaagagtgtcaggagcaggatcttgcgtatcagaggatggctgcggacagcatgatgctccccgcacagatgctgcctttgcaggaagtccgctgcaacatctgtgaaaacatgatcatctcttggtactttgagaagcactcaaagatttgttcagaatggcacaagatcgagatggagcttcagatctgcaacgaccttctgcgggagcttctttcgcatatcaatgcgctgaaggagccgcttatcgcccaaccgacgaacctggacgacggagcgccagtcaccgtggatctggacgccttgaacgatctacaggctatcacccgaacagcgctggccatctcaacccctggacgcgacgccgaaactgatgacaaatccaacaaggaatctgccaccagacctgccatccagtccccggcttcagagtcgcgcatgtcggaggtcttccgctgggaggcacctgtgacgagcgatgccgccatcatgacgattagcgacagggtagacgcggcgatccaccacaagactgcgcttgtatcgcatatgaggcagatcgctgaggaagatgagcgtgaacgcagtcgtggctatggtctcgatgaggagcttgcagctcagtgcagcttggagggcatggttgttcccgaagtcgtggagcaagaggcctcacccgtggagccctctcaagagtctgcatccgttgaactctcgcggacggcctcagcatcatccgatgttggtactggaggagcatccgattctgctgaatcttctgcaacggtcttcaaggtcggtgcggccggaaagcaagccttgcagtcgagcgttccatctgagcgcagtcttggtagccaagccggcaaggcgagccaggatggccaagcgcccaagcccacccaatcgagccaacccgggcagcctggccagactggctcagcgagttcgccgactgtggtgcggaaacaccgcccctcgtttgtggacattcactctgcctcgtcgttcttcccagagtcgcatctctcaccacgcgtggcgaacagattcctggcccctcattcagtggatggctcacccacggacagcatttcgtccgcagccctgttgaaatcgcctttgtcgccttcgttcccacagccaactccactgacccgtccaacgcctcccagcatcaaggatttcgatttcatcaagcccatttccaagggcgcgtttggatctgtgtttttggccaagaagcgagccacgggcgactactttgcgatcaaggtcctcaagaagtccgacatggtggccaagaatcaagtgacgaacgtgaaggcggagcgcatgatccttatgaaccagaccgactcgccattcgtggtcagcttgtacttttccttccaaagcaaagagtatctttacttggttatggagtacctgaatggaggcgactgcatggctctcatcaaagccattagccgccttccagaggactgggcaaggaactaccttgcagaggttgtcttgggactggagtatttacataatgcaggcgtggttcatcggtaagttgctggtgacatacatgggcgccacacagtgatgccactcacccggtctgacatctcgcactttggaatacctcatctaacgctttcttcgtgccttttttcaatgttttcttttgccgcggactcgcctcattcatgtggagatagtgatttgaagccggacaacttgctcatagaccagaacggccacctcaagttgactgactttggactgtcgcgtgtagggtttttgggtcgacaggcgcaaactgacagacgatccaagatcgcattgccctctccttatccagagtcgcggcccatgtcgccatacctcttttcacatggagcagagtcaaaccacgagtcaatccctatgatcccaacccccaagcttggcccctcgaatccatcgtactttaactggggcgagcgaagtcggcgctcctcaaatgccagttctgcatccatcgatggtcggtctccagccattggcatggctactgcagatttgccgcgaatgcctgccgcagccgtgctgacgtcttcgtcctcgaacgcgccattcccgatatccgagagcagcgtgaagtcctcaagctcgtttctttcaggagcattgcaccctttgcacacgatgtcgcccaagacttcgcaaggaaactcgcctttgatgcccccttcgtttctgctgaacgatttgaaggaagaggctcctgagaaatgtgtgggtacgcccgactatctagcacccgagtgtgttctcgggttgagtcaggatgccatggttgactgggtaagtgccgaatcgtagcgctagagaaagactttgacaaccgcgtaaatgggctctagcaaaagacttttctctctccagtgccacacactaacctcatctctcttctaacctcgctcgtcctgacatatttagtgggctcttggcgttatatgctacgaattcttgtttggctacccacctttccacggcgatagaccggagcaggttttcgaaaacattctctcgcgcgatattgactggcacgaatcggagctggagatctcacccgaagccagggatttcatggaacggttgctgtgcgtggacacggagaaacgtcttggagccaatggcgcggaagaggtcaagaaccatccatttttcaaggatatcaactgggacacactgctgtcggagcgacctgcatttgtacctgcgccggctgatatcgaggacacagagtactttgatgtccgaggcgcgaagatgggatcgttcaaggaagatacagacttgaaggatgtgcaggccatggcgaatgctcttgttaagaaggacaatacccaagctagtacccccggacctcagccgggcacgccagcgacttcggaaggatcgtgttcaacgccaccagcattatcgcttgatgctgcaggccaacttgactctgctgtcacaccgcgtgcacacacacctaaccatgaggacgaggatatgtcccaggatccggattcgtccaaggacgacagtggagctgactttggcacatttgcattcatcaatctacccgtgctggagaaggccaacaacgacgtgatccgcaagcttcgatcggacaatgcatttgcgtcgaacagtggaagtagtatgtcgtcttcaatctcagagttttctgcagagacaccgatgacccctggatctatcagcaacctgagcaacaacagcaacagcaacagccagatcaacatgaacattacaaagacaaagcaccgatccatgacagctttgaccaacactccgccactgcgattcgaaggcaagaactatttctcctattcgcccaagggatccccatcgtctaatggatcaggaggcccacttggagctcagtcgcaacagcagcagcagcagcagcctttgcagtcgggagacggagtgacgcccaaagagggtggcgagtaccaaccgcagagatcagcttcggtgccagtgacatttggcgaggagtattcaaaaagcaatgtctcgcctctggagcatccgcacgcggcgcgtcgggcgtccatgcctctgcgtccgcgaacccacagtgcaggcaacacggacattcatccgtttgtgataccgaatacagggtcaccgacgtcgcctggtggaccgagcaagacgcttccacaggtgaatcacacgcgtgatcgccggagtggatcgacgagcagtagttcggggcttcgatcgagtcggcactctctcaaggcgactgcgacgcttcgatcgacggccaagggcagtgcagcgcttcgcaagacgtcgcggacgcgagactgtttggtggtggatgataacccgatcagtgccaagatcttggagacgatcctgacgcgactgaactgtcgctgtgtggtgatgaggaacggagccgaggcgattcgatgtgccatgggcagtgtcaagtttgacattatctttatggatattcgcatgcccatcagtaagctttttttttatttgtttcacttgtgttttttcttttgttgaatctgtcagcttgtttttcttttcgcttgatttcatattacgtcaggacgctaagattcttttcttttcttttctatggatgtttttgctaacaactttagtcgatggagaaacagcgacgaggatgatcaagtcgacgcagaataccaactcgttgacgccgattgtggcggtgacggcgttcccggatctggcggcgcagatctttgattacatgatggtgaagcctgtgacgcgggaggagattgagaagcgactccagttcttttgcccgatccagcccaatgtgagtgaggtaccgacgcccattaaggagtgtgttccaccgatgggaccttttctggcgacggcgacggcggcagcggcggtcgggatgggagcaggcgagtttttggccaagagtcgatcgggatcgatgtcgtccatgtcgacgcgaccgatgctgtttgagcgagagcgtggccgggagcgcgagcgcgagaaggaaaaggagagagaaagagcgaaggagaaggagaaggagagggtgatgcgagaccgcagcactggtggtggagcgagcggtcatgtggaaggtggaagaatcgaatcaggaacaaaggcggtcgctggagcattagcagcatcagcaacttcagcagcatcagcagcactagtagcagcagcaggagcaggagcaggaggagcgctagctgagagtgagaacgaggagggagcgtctacgccttcgacggaaggggcgtctagtatcaaccccgagactgaggaggaagatgaggtggtggtggaaggttagaagaggcagaagaggaaggagcaaagggcgcagagggaacgaccgcctcgtccggaatggctcagcagtagtgtagactgccaccagtaaattgctcatgtacaatattgaaggaatggtctactggatccattatctgatcgtgttgtgttgtccgtgatggtcgattcagagtagtggtgacttgatatttagagcggataagtagaggaaagagagagagtgtgtgtgtgtgtctgcatgtggtgcacagggggggaccagggtaggggcgagttgatgaatgagaaagagaaggagaggaagaagggaagaagggaaggaagggggggggggggggggtcgagcaaagcccaagaaaaaaaaacaaaaaaaaaaagggttgcgaaagtgacaagacgcgcgtgcagcttagacgcgctttgtccgtttgtgtgcacgagtggcccacccctgattgcgctttatggtttgcgcttcgacattgtcattggctcgcccttgctctttccctgctgctccttcccgcccaagcgacgttttttttctctctcttttcccgctcctccttgcctcctcttctcctcgtcgtcctttgtccacttctttcctctttcctctttcttcttcttttctcttttctcctctttcctctttcctcctctttcctcctctttcctcctctttcctctttcctcgttcctccatcctcttgttccccattgctcgcgtccatcccgaatccatcccccagctcacccacctccgattgcagccatggccacaagcgacatggaggagcagcagccacagcagcagaatggccatcatcccgccaccaatggcccgcccaacggcaagcccaccatcctcaagtccacaatgcgcacaggcagccagagcagccagagcagccagagcagccccagcggctctccgcgtccatcctcaaagacagtccacttccaaaccaccacctactccacctcgtccctgtcctcgtcctcgtcttcatactcgttctcttcctcttcttcgtcttcttcgtcctcgtcctcttcctctttctcctcgccctccgcttacaccgctgcttctgcatccatctccagctccaagctgacaacaacttccgcatccactgcgtcttcgcgttcagcatgggtgaccttggagtctctggttcatggcacagtccttgcgctcattgtactccacatctttgtagcgccctacacaaaagtcgaagaaagcttcaatctccaggccacccacgatatcttgacctttggtgtctcaagtgagggcgtgaaacaggtagtgtgtctttcgatactgtcactgcatttgttcaacctgtctgctataaaatagaaggacagggcgggatcaggatctttatgcgcaaaaaaaaagctgacccgttttttgttgcgttgtagtacgaccacctggagtttccaggagtggtaccgaggacctttgtgggacctttgctcttggcggccggcagttggcccattatggccatagcacgtctgcttgcacccggatcagaacttcccaagggtcttgttggccagatcattggtatgttggcaaatacaaggttgtcatccttgtgtgtgtcctgtgtatatactttgtgtctatgcctgtgcctctgtttgtgttttgggtttttgtgtgcatgttatgtgggccggaataccgttgctttttgtcgtttgagtaatattagagtcccgcccacaggcatgtttgcccccaatgtccgccatgctatcccccttgaatttttttttttgtgtgcttacgtgaggattttcctgctactgctttcgattgtccggcatactcctcccgcagacctgaacgtccgataagccttttaaccacacgagttgggaacaaagaagaaaaaaaaaattggctaacgcgcctcctttattcagttaggaccgtgttgggattgatgacatttttcggatggcagcagatgagccgcgggattcagcatcagtttggacggactgtcagtctattgttcatggtcgtctcgggcgcgcagttccactggttgttctacgctggccggactttgcccaatacttttgcgcttgctatcggtaaagtgtagctttcaggagcaagaagcaatctgttgaaccgtccagatttcgccacgctggatgttgaccattttttctttaaaaccccctcccctctcatagtcaacgtggcgtactcgtactggatgcaagcctcacaacagccctctcgtcgtgtagtggagcagaggctgatgcggatgattgatgcgctcgtcgtgggcactattctctttcgatctgagctcttgatcctgctgggacccatcgttctgctagagttgattatgactcgcattcgtttctggagaacggttcaggaaggtctactggcgggtgttctcagtatcggtcttgcgattgcagtagactcttggttctggaggcagtggatgtgggccgagggcacggtcttttggtacaatgccattctcgggaaatcggtcgcgtggggtgtttcgccgtggcacacctatttcactcagctgttacccaagatttcgggagttgctttgccgttggccttggcggctgtggtggtggagcagaggttcagacggtatatgcttccggcgggtgtctttgtcggactgtactcgttcctgggacataaggagtggcggttcgtggtctatgtggtgcccatcctgaacctcggtgcggccatcatgatctcttggatgtaagtggcccatgttgatcgcctagttggttgccagttctcttttgctcattcggaacatatgtatcgttgggtttactgacgaatcgtactttccttttgtccgctgttctgtaggatgaagcgcaaaactctggcgcatcgaatgatgacccttgtcgtatttgggatcttggggctgagctttctttccagtctgatgcagtccttgatctcgagccgaaactatccaggaggtgttgcgctgcagcggcttcatgagcttgaactggatcactttgcagcaggtaaacaaaaacccccccccgccccccgatcgtaaccccacgtgaggatccatgcatggagaatttgtgtgatctacagttcaatttctgctttcttatccagattcacctttttgtaaaaaaaattagcaacagtccacatagatggggcagctgccgagagtggatgcagtcgctttggcgagattggatcgtcgttggatttggcgttgttctcgtccgaatacccttattacccctggacctactccaaggacgaatctcaccggtcgccgagggattatctgcattacacgcacctgttgacgagcaagcccgagtttcatcgacaggattatgaggtgctggagcagattgatgggtatgcgggattgagacgcgtgtcgctcgcggagatcaagaggacgtgtcctaaggccatccagggtcttttagcaaaggagaaggaagatgacgaggaagtgaaggagaggaggatgtcttcagcagccgatttcatgactcggatgagaggaaaagcagaggaggtgtgggtgggatgtagtcctgtgcagatcaggacggaggggaggatctggatcctgaggcggatcggagccgtttgaaagagattttgtttgttcactgtttccttaaaaaaatacatgtctatctaattgtagtccgatgggtggtgaggcgtgagtgtgtgccgcgcgcattgtaagtggggggtttgatcccatccatcctcttcccctccgttcctgcatgtgtctgtgcggtccgaccatttgcatgactctgttgggcaccgtgggcgataacggatgcccgttagaccaagtggccacctgtgaaaaacgttctttttttcgtgtgttttcggcgtagatgatgaactcgtggtgcaacaaaccccaagagaaccagaacgtatccaccgcgtatttcttttaaagttgaacattgccttctacaaaaaaaaaacaagagagttgtccggagctgatcgtcgcactgattccgagattctccacctctagaacggacgctctccaagacccactttcgggcgatttttttttgtgtgtgtttctcgcgcgtggcatttcacacacacgaaacattgatagcagatactgtagcaagcactctttccagttcgattgcctccgacaggcccaggtgccagagtgataggtgctttcgttcttttttggtcttgatttaaagagaggaggaaagaggacaatccccgtgacgtttacgctcactatgctgaaactgtggacgtcctgtttctttttttttttcgttagtctctgtacaatacaagcctgcatggacgccgttttaatgcccctccaagcaatgccggtagtttttggcatgatgtcataggatcatcttgggaggagaaaaatgttcctgaatgttaaggtcgctcttaaagggaggatgtgatgttgtggagggaagcaggattcggtaataggccgggttttctagcatcgtaaggagatagatagcgatgcaggcttgacctagggaaatttacggaacagaaggaggacaagagtcgttggctatggcgatgggcctcaatagtgaggatcgtatgtctgttgtgtttgagcaggacgaaaggatcccgggagcgaaacacagcgactgaaatcaagactgtaggatgagtggggttacagtagtctgcagctgttgaatgtggtatgtgtctatagagtgtccttagtctatgcgatgatgatgatgatgatgaaggatgatgagtgacaagagatagggtccttcctcggcgagcctggctggctttgaggggttgagtgggcattggtgcggtggggcaggcgaccaatgaggggcggcgaaggggactgaatggccatgcgataaacaaaacaaccaaaacccggcctctgtcagctcgactcactcggtgcctagcgagaatcatcacaaaaaaaaaaaaaaanaaaaaaaaagggaccccagtggaaggaaagggaaggaacgcactacacacacacacacatccactaccagtgattaagggacaggacgggcgattagagagtcagcccgtgctataaaagggatctcacccgcagactgatttagcctcattcatccctctttctctcttccccattcctccattgccccgtcctagcctcgctctctctctctttctctctatctcttgtacgctctctctttgtctcttgtctttgctcgctcgcctttctgcttctcttctcctctctttctcgctctcgtcttctgctactgcctgtaccataccaactcactcctccaaacaccccacactcccttctaatacataacacagccatggtcaacaccgcccgcgtcgactcgctcaggagcatcatcgagcgccccacccgcgtcatctcctaccccaagaagcccgatggcaagcccgtctacacctccgagttctttggcgagaacgtcttccatctgcagcagatcgccaaggccctgccaaagcccgcctatgcttccttcctcaagcagatgagaggtcgccaggccctcgaccgggccactgccgatgccatcgcccacgctgtccgcatctgggccatggaccgtggtgccacccactttacgcactggttccagccccagaccgacaccaccgccgagaagcacgatgccttcctgtcgctcaagtcgaccttcaccgctgctggtgaggaggtaagaataagagtcgttgttggatcctccacatacaccccttgggttattcaggcaggactgaataaggaagagtggatcgatcaaaaaagggatgtatctgacctggagggcaaggaaaaaaaaatgatgagtcgtagtgattcttatcgtttgtgtgggctatcttggacttccgactcgagcaaaacaaaaaaaagaaaccgacactccgtcagtcgaggcgctgtacagcacatacacaacatacacacacacagtcatatacaccttctggatgcaacggatatgtgctagcaaaacggccgagagaggatcgacgctgcattaccagcaaacatgtgtttagatccaaaagagataataatagagcaacaaagggtgggaaaaaaaagagtactaccagcaaacaaaaaattaaggtcatggccgttttctcactttctcgtttcctctctgcctaggtcactgccatcgacgccttctctggatcgcagctgcttcaggccgagcccgacgcatcgtccttcccctcgggaggcatgcgctcgaccttcgaggcccgtggatacaccgtctgggacaccacctcgcccatgttcatccagtctggaccccacggcacctccgtcctttacatcccctcggtcttcatctcctacaacggtgacgcccttgacgagaagactgtcctcctccgttcgactgagcagatctccaaggcctgctgcgagctcctctccttgatcgagtctgtccccgtcggtgcccagccccgcaccaaccacgtcttcaccactctgggaactgagcaggagtactttttgatcgaccgttcgctctacgctcttcgccctgatctcaagaccaccggtcgcaccttgatcggaaacttgccccccaagcaccagcagatggacgaccactactttggacgcgttccctccaaggtcatggccaccatgtccgaggccgagctcgagctcttccgtctcggagtgcccgtcaagactcgccacaacgaggtcgctcctcagcagttcgagctggcccccatctttgaggaggcctcgctcgctgttgaccacaacctgttgaccatggacgttctctccaaggtcgcacacaagaacaagatgaagattctctaccacgagaagcccttcaagggcgttaacggctctggaaagcactgcaactggtccatgtcgaccgaccacggcgagaacttgcttgaccccactgtcaagcccgagaccaactaccgtttcctcctcatcctcgttgctgtcctccacgccgtccagcagcacggtgccctcctccgcacctcgatcgcctcgtcctcgaacgagcaccgtcttggtgcctgcgaggcccctccctcgatcctctccatcttcttgggccagcacttgaccgaggtcctcaactcgatcgaggagtcccgtcccatcaagaacttttccatgcccgagatccagaccatcactcttggaggcactgctttggatgtcaaggtcgcctcgctccctagcatctcgcgtgatctcacggaccgcaaccgcacctctccctttgccttcaccggcaacaagtttgagttccgtgctgtcggatccaagcagtcgccctcgttccccgtcaccattctcaacgctgccgtcgcttcggcccttcaggacgtttcggccgctctccgtgagcagatgggtgagaagcccttcccctcggatgccgacaagattgcggtcatcaagaagttcattgtctcgaccaagaacattcgcttcgagggcgatggttactcggatgcctggattgaggaggctgagaagcgtggactgcccaacatcaagacctgccccgaggcctttgagcagctcatcaagcccgagcacatgtcgatgctcatgaagctcggtatcttttcccagtctgagctgacctcgcgcttcttcatcatgaacgagcgttatgccaaggatttgctcgtcgaggccaacaccatgcgcaccatgctcgctcagcagatcctccctgctgcattcgaataccgcggttcgctcgctcagtcggttcagctgctgagcaccatccccggcgaggagcagtcgcccgagttgtcggcgctcaaggcgttgacgcccgtggtcaaggacttgcaggcgtcgattgttggtttggatgaggccattgccaagttgcacgcgatccatgacgatgctgtcgccgaggccaaggccgccaacgagttcatcctccccgcgatgcagattgctcgcacggccgcagatcagttggaggtcttgaccgccgacaagttctaccccatcccccgttacagcgagttgctctggttctaaacacccacgcacatagcgcttcatacaatccacgcgatctcatttttttgtgctttcatactctcgaccactcttttcaaattttctatagattttgatttttgtacattttcctccttcatctcctatcacaaaaaaaattacatctagaagttattcttgtgcgctccagctgaagctgctaccttgatgtttgtctttttcttttcttgctcaacagttgcttctttcctgcggcttgatgcgtttcccccatctgtcccaagaacgatgcctctcgcactgtgcacttacgcgcaaacgaccccgtactccctttgatcaacagcaaactgatgaatttgattcccgtcacacacatggccacctttgcttggcaggcctgtcctctttgctttgctcgttctcctcgggtcgagagacctttttcctcctaccacccccacacccccctcctcctcctcctcctccttcagaaaaccccacacaggggtatgaaaaacgggcctcctcctctaccggtcctgttctcccttgtcattcatactcattgatcatacgagctgttcttcgcacacttgtatcgacaaagtcacaccttcatttgacacacatatttcacacccaccatccattcagcatggaagattctctgtcacaagcgtaacagggggcagatctctagtcactgggcaggtctccagtcactgggcattcgtctcaccgccttgctgacatccgcgttcacacctcgtcaatgggagccggttggcacgtaagggcatcatggtgagctcaaccgcgattgttgctcatgagtaaatcggaacaatgcctgccattgaacattatgctgaatgtattcaacgatcttctcctttctcctgcatgtctgacagtcataaactacaacctgctctcgaggagtctggcggcagttgactccaagtttagaaaaagaacttttctaccgaatccattagcgtggttgggtgcgtcaggtagaatgacgcgtcttctgaacgagattacaagtaagaacatacttctgactggatctcagaggcatagctccatgcttttgatcgagcaagttggattcttgatattgacttgtttctgtgcgattgttctttttcgctttcgaaacaaatcattaggttacaatgtggatgccttgtgcttccaagaacgcgacgacaccgactacaatggggcattcagcgacacgatgaccgctcggggttacgcgggagtggacagcaagagaatgtccacactgaatcacggatttggtgtgtactacaacacatctaggtaaatgaaaatgcactaagcactcacagtgcgcgaacgagggatggatgtcttcgaaatcaaaactgaaaatacattttgcgtatggacctagactcactctcgtgagagagtgccccatctctgccctggagggagagttcggccccgaggtggagactccaggcgcaatggtcgtactagacctcaaggacggtaagacatgaatggttttcatatattagcaccccgaacaaatagtacgctttgatcagtcactcattatcactcaatactcaatgatgaatagggtgcaaggtgcgccgactgtgtgtggttagcacgcacattgtttgctgtgcaacgaaaggatttgccaagttgcagcaaatcatggcccttctagcggcgatccaagggcaactgcgaattgtcccggacatggcatttggtaagttacgacgaccggtttctctgcactgtccgtgaacgttgatccgctgtgatgtagatgctaatcatgtatatacctcgcccgttcatatctttttctactggactagtcatggccggcgatttcaacgcgttggccgacggtctactgatggactacgtcctctcaggtacgtctaaccacgaaatatgcggtgctgcatcagcacaaaacatcggcaatacagtactcttgacttagagccactgactaaaatttcgttactctggaaaactttaggatcggcagacctgggagtgatggctgaggaagcgttctcgcgggagacgctcgccgaagcagagccggctgaccaaagccacctcgagagggcagctgcttttaagctgcagaccagaggcctgagggacgtttccattccctcgacctttgcctccctacgagaggagatccgagctacggtcacactgagcaaagagcaacgggacctagcggtggcacacccgttgcgaatgttcagtgcctacaatttcagttgggcggccaccattgtggacttcctgttccacggtcgcgcggtgggcggcccacgtctcgagattgttgcacgcctcgcgctccctgagaggctggcacgtctgaagggtgggctgccagcggggcatttaggctccgatcactttgcgctcggcgcaaaatacagattcaacgatgagcgcctctgggtggatctgccaggcgcagtccctgattacgagcggctatttgccactcttgattgaaggaggcgttcgatcaataaagtataaagtagatcagtcggggcgtgtcgttagagctgaacttatataaggcatgctgtgccggatggacatggctacatgtattggcgacagatcaagagtaagtgtggtaactgaaagcgagaggacttgaaagcactttgaaaccaacaaggttttgaccccggctgtcgtattgttgtattatcatattgtggcattcaggtcgctgctctcagcatccttaacagaatttgatgtacgggaaacgtctctaagaagctgtacctaaacacatcgtacgtcgccaacacttaactctgagaccgcctccctggcagagggcttcgacctgggcaaacgctctcacccgatgatgagctgctatggcaacgaaaaggcggaagcgcgatgctagtgtaataaatttgatggtgcagtcaactgctggataccaggatgagctttaaggtgctgatggatggcactgtttaaaaactggacactgcaattgctattttattatcgtttcgactcaactgtttagccctcgttcaaggtctttcccgaacggcttactgccgcactctgtacactgttagaatgcttccttgataaaaccttcgtctttctagagaagactgccatggcagattaccataattttactgggtcatcccgtcctctgaccattgcacaggctgctggtattgtgtttgccaggtcgtagctttgttttcttcaatgcagccgccaaaggctggaacgagaaaggttagcaagtgtgaagtaacccaagtgtatgtgacccagcgaagaaaaaaaaaaaaaactaagtgccgtcaaaagtgtgagaatggacgttgaattaaaagaagaagcgtgcccggaacgacagactgttctacagaacgatactgcgggcactaacctgataatgtcctagggacatcagctccagctccccccagaagcataccgagctttctgggcggactcactcatattctggaacggcagcctgtgtggtggtgcccaccaacgctctctccataacaatcgctgaacctggcaaattgctgttacaaagagtaaaaccactgtttctatttaaacccgcttttaaggcttagactttcagaaaaagccaaacaagatagcctgctcctccagcgtctctgtcagtttgctacttgagtctgctatcgaaggtcaaaacgtccacctacctctcctccattcatcgccctcatcccctcaagacaaggaggagaggtaggtggacgttttgaccttcgatagcagactcaggtaacaagagagccagtgtatcgtcttacacgcgcacgtgcatttcccgacctatcgtgactttgtttggctttgtctgaaagtctaagccttaaaagcgggtttaaatagaaacagtggttttactctttgtaacagcaatttgccaggttcagcaattgttatggagagagcgttgggtgggcaaccacccgcgacaagctgccgttccaggatgagtgtgtctagcagaaagcctcggtatgtttctgtgagggagctggagctgggtacccacgggcccatcaggtttgtgcccgcagtgtagactgtagggcggtctgtcgttccgagcacgcctcttcttttgattcaacagcaccacaacatccctctgttttcaccacactttttgacagcagaaaattttcacagagccattacgctgggttcagttcacacttgccatttcacacctcgcgcggttcattgcgagatgacccaagtcgtgctcaattgttcccgtgcaagcaagagcgcgctgagcctttgcggcgcctttgagggccgcagccagatatggcgatgggtgtaggcgtatccaaagcaggtttgattgctgtatcaacgcacagtaggttctgcagggcagtatgtcgttccgggcacgcctcttcgtttgattcatcattcctcagtttggctgcacttttgacagcacgaattttgtactgggtcaatgagctgggtcatttaacacttgctatttcacgcctctctcgttccacggcgggatgcagaccatccctttgccggacctattgcagcaccctggaggactgcagtcggagatgtattcgaaaaaaaaagctgcgacttggcaaacaccaacaccagcagcctgagcaatggtcgtgggatggcctagtaggactacagtaatacgccatggcagtcgtatctagaaatgcgaaggtccttgacttcatcaaggatgtattctaacagcaagtacagactgcgcttcagcaaagaaggatcagcgtccttgaccgagggctaaatagatcaataggaacataaaatggcaatacagtgtccagttcttgtgatgcgggccttgaccatgaacatgcagtgctgaataccgtgtgcgcttccccggcgaaccatgacagtctgtttccacagtttttttatgccgcttgataacgtctgcctgaaaacgtaagtttgaatgtgcctatgaggcagggctttggtgtcgtctaaatactatggccaatgatatctaagtaggacggtgagcagttgccgatggcaagaaggacgtgatgaatgctgggccgaagggagttgacacttgaggccttctgactgtctgttttagatatgtcacgctcgagcggccatccacaccaccccgaagccagtgagacgcatcggtcatcaccctgaagctcgtcatggcatccagcaagggttgactgcaacagaacaaatttatttcactgtctaaccacgcgtttccgcgtctcgttgccatgacagctttgcatcgggtgagagcatttgcccaggtcgaagagctctgcaagggaggccgtctcggaggtcagtgttggcggcgctagatgtgtctagacactgcttctttaggacgtttcttgctcatccagtcatcgggacctgaatgccataatatgacaaaacgacgatacgaaaaggatgtgttccttggtcgcacactgtccaatcataagggtcaaaaccttgttggtttcagagtgatttcaagtcctctcgctttcgattaccatacttgctcatgatctgtcgccaaaacccatgtccgtgcctagtccagcgtgtgctttcttcggcatggcgcccctagttcaatcaagagtggcgaacatccgctcgtagtcagggacggggcctggcaaatccaccagcatacgctgatcatcgaagcggtacttggcgccgagcgcgaagtggtctgagcccaaatggcccgctggcaatccacctttcgaaagagctagcctctcagggagcgcgaggcgtgctacaatctccaggcgtgggccgcgcatcagtcgaccgtgaaataagaagtcgacgatggcgaccgggctcttgaactcatacgcgctgaagactcgcagggggtgagtgaccaccaagtcccttgtctccttgctcaaggcgacttcagcccggatctggtccctcatggaggcgaaggttgaggggatgaccacgcccctcaatcctcgagtttccttcttgaaatcagcggctctcttgaggtggtcctcatcatctgaccccgccccagaataccacggtctcgcgaatccactctcggaaaccagtcccaggtctgccgctcctaaaattttgcacggtgttataaagtgtaacagaaatttagatcgagaacctggtgaagggtggacgcgttttgcactcgtatagcaccgcatgttttgtgatcagacgtaccagacaggatgtactggatgagcaggccctcgggcagtgcgttaaaatcaccggccatgactattttagtaaaaaaaaaaaaaaaaaaaaaaaaacgagcgtggtgtatacataagttactgcatctccatcacggcggatcaaccttcatgacaagacagagcagttagttgtcgcacttaccaaatgccatggccggatcttcaagcatctgccctcgggccgccgccagcagagccatgatctgatgcagcttgaggaatcctcggggtccactgctcacgatatgtgtactgattatacacacccggcgcttcctcgtgcctagtcaccattgagtgttgagcgacaatgagtgactgatgaaagcgtgcaactgttcagggtggtaattcaggaaaaccatttacgtcttaccatcttgaatatcgacaatgaccaggattcctgggcactcaacgtctcctccgaattcaccttccagggctgggacggtgaactcccggacgaaggtgacgctaggttcataggaaaatgtgcaaaataatcatcgtgagcaacattctttctttctttcagatcttgaagatttccacccttcgttgcgcggagataaacgcgtggtgtgtctgaattacctcgaggtcctgtaaaagaccccgaacccgtgctccagggccgctttacgcttcccgaatactcccctgtacccgagtgtgctcatggcccgaccaaacgcgctgtcatagtccgtcttgtcgagctcctgaaagcagacgacgtctgcctcataccctaatgatttatttcgaacgcgaaatcgacaatagcacagaacatgtcaatgtcaagaatacaacttgctcgatcaaagcatttgagccgtgcctctgagctacagtcagaagtattgttcttacctgccatttcggtcaaaagtctgaccatccttccagaaggaccacgccatgccaacggatcgggaagaaaggtattcgtcctgtatttagagtctgttgccgctaaactcttcgagagcagattgtatgctacaactgtaagcgaggctagagaaagacgagaatggtttaattcatttggcctgaagctcagtggcgttgttcagatctactcctgcaacaagaaacgttgttgggcttaccagggtacccttgcgggccgaccggttcccactgacgaggtctatagtcaaaccgcagcaaggcgttgagacgttgattctgacgactgaatggcgctcggcggcggcctggtgtggaatacgagatcaacgaggtcgaagaggaagacgaaggcgttgaggacgaagcagacgaggaggacgcggcagacgacgaggactcaatggacgacggggacgcaacagacgacgaggacgcaacagacgacgaggacgcaacagacgacgaggacgcaacagacgacgaggacgcaacagacgacgaggacgcaacagatgacgaggactcagcaaacgacgaggtagaagaaggcgaggtagagaaggaggaagtagaagaggaggaggaggaggaaacggaagatgagggggaagaagtggaggcgaccggggtgcgagcggcgcacgaggtggagaagggggaggaagtagaggaggaggcggcagaagatgagggggcggaggaggaggcggccggggtgcgagcggcgcgcgagggacgaatgccctgagacctgctcctataacgtctgttaatatctttcatgctgtagtggtagatgggtgggaaatgtgtgtgtgtgagtgtgtgtcgatacgagtgtgaagaacagctagtatgatcagtccgaatgaaagacgagggagaacaggacaagcagagtgaagaggcccatcttttataccctcctcccccccctgtgtggcggcagcagggcagtcaacgctcgccattgcgtctcctctcaacgttgtagaaggtgtgacaacgtcagggtctttattcaacgaagatggcaacgaaaaatgtgcaccgagcgagcgcatgaagcacggccatccgtcactctatctggtgaaaaaaaaaaatattctccactcgtccacacacctggccatgaagatatcgacaccgcaagcttcagagaacaaaaggtggcagcgagagcggcggtatcatgacggagggacgcgcgttctttccaacgaaggaaacgaccaggagatcacagtgctaaggtcatcctttttcatttgtatgaaaacaacgcgttcttccaagggagtggatcaacggccagcattggatcgaatgaacagcgagagctgcacgaacatcacctccctctccagatcatcatccatgtgtgtcgaactaagggaccaagtccaggcacgcgattttctgagatgcttgcaggggatcgtttggatcgaacggcaatcaacgtcgttgcgtttttttagagaggggggagaccattcttcctcatgaaccccctgcaaaaaaaccccagtagatacctgtgcatgattggtgcggtggtgccatgcaattttcctctgtgcaaccatgcaaaggtctccctgtacgcagaaacgtggttcaaaaagggtaatatccgtcctctcgtttgacgttttggaccagttttgtacgttcaggcaatgatgtagtttgtgcatcaagtgcaacctgctgcaatttgccgatcccacaacactagcatctgtatttattttttggtgaacgactgttatccattcaacctgaacccatttgcagagattcgtgatgagaagatactgtacacgcgagctgtttgtgagaccaactagctttttgttgactaaatcggccaatcgtctgccccttgagagcgacgcgaaccaaaggcacgggccagcttccaacaacctgcggtccctgagataaacaaatcttcccaaagccaaccaataccagtgaaaaaggtcgcgcctgagatacataaatcttccaaccaacaccagcgaaaaagaaaaaagatcgcacttgaaggagcggtattacatttttttatatagcaactgttcatatttgttttggcggcacttaaagtacatgaagggggcgtccatttttgtttctattccttcttcctttggaagcataaaagtcatcccccccccccttcctcaggtattcctaacctcttccatggccatatctggtaatggactcgcgctcctgggctctgcagctttctccataccaggagcaggagcaggagcaggagcaggagcagatgtctcaggcacacgagcctgctcatggatctgctcgaccacgtccttgacgcgttcttgcgccggctgctggtgctggtgctgatactggtgctgctggtgctggtgctgatactggtgctgctggtgctggtgataaggatgcgggtggtacggcttttgcgagtactgcgcgtgttgctggttctgctgtgggtgccgctgttgctgttgctggtgtgagtgcgagtgctcgacgtcatccatgtccgagggcgactcaaatcgtcgaccacggaccgtctcctcctcgactcgcggcaacggcaacgatccctcgtcctctgcaccttcctctcgcttctgagccgacaagcccttggacaacgtccgattccagtccccagcggaagaggcggcggatttggacatcggtggcaaactgcccacactgctcaagctggtggtgcttcgcatgctgctaccactgctgctccggctcgtgctcgtgctcgacatccccttgtcgccgtcctgatccacggccatggtggcagagggtgctgcaatggcagtggcaagagtgctagaggtcgctgctgctgtctggcctgctgcaggatccgtcgatgcactggaatcgtccgttggctccgtgggagcaccacccgaaacaatgcccgcagaggcagcagcctcagcccgttgcttctggctctccagaatctgtgcagcataggcagccttttgtccacaccctaatccacctccacgtcccaaatgccgacgcaatgcatccggtcgaatgaactgatggtggcagtatgagcactcgaacggtttgatgcccgtatgaagcttcgcatggcgatttcggtcgtgaagtcgtgagaaggcaagcgcacaggtatcacacttgtaaggtcgctcggccgtgtgcacccgcatatgcgcccggaggttgaacggacgtgtgaacgacttgttgcagttggggtgcggacaagtgtggctcgcttgacccgatcgtcgggttggcttcccattctcgtccatgctttcccgccggtcgttgccgtccttgctcgttgctggatggatcggtcgcaactcggatgctgagctggacaatgaggacgacgaggaagaagatgctcctcctgcagggcccatcggactcgatcctgcgggagccaaagatcgatgggtattgctgctgctgctgctactgtcaataggcagggctggtccctgcagatcgtactcatgtcgctcgcccgaggatcgcacagaactctcgtaggtccttgcagccttgtttgaggggccatcatgggccgtcgattgataagaacccgatcgcttttgtcctgccccgactgggttgcttccatgacgcgcattttcattcacctcgccatgaggcgcaggtcctcgatttgcgccattctcctggtaagtatacggcacaggcaagttcagtccgaacgacggaagcatgcgatccgaccgacgctcctcttgtatggactcatactgctggggcgagtctctagggtgatcatacgatgatggcgaggatgggtatcgcgggtgggacgcactatgctgacgatgcatgggcgacgttggggggcccttcatcctggaaccgggcgaggacggtgaaggaggtcggtgttggttatggaacgacgagttgttgtggtacggagccgatccaggctgatgaggcccatcccggtgctcgggtgcaaggcggattgagggtaacgagcctgtacgcgtgggtgggacatcaacaggatgcagatatctcctgagtcccgatgagccgctgtcgccctgtcccgattcttgcgagtaatgggttgcatactcccgcagcggtgatggagagcgcattggcacaccacgctgcgatggagactgtgagtgcatcgattgcgatgaaggcctagttcgagcaacctgctgctgctgctgttgttgttgttgctgctgctgctgactcggacgctgtgagggcgtcgacattgcctcacgcggagccagatgtgcatcatgatgctcaactgacgcctgagcttgcgactcggaatctcctgatagtgacttgacgtacatatttccacttgaatttctcgccttcctggctcgactgtatgcttcacgaatatcatccttgagattgctgtgaccattgctgttgctgctactgctgttgctctgattgatagagtggtggccacggcttggatagccatcaaaggacgacgacaatggtttgggtggtacagcatgggcttcaggaagtgggtccagtcttgagtgatacattgcagcaaattctgggggtgtgctggaagagtctgcaaacaaatgccgtggcagtgcagagtgacaattcaagacctcccctgacgccccgtgccgttccagtacttcaaacatggccacttgacccgtccaagccgcgtaatgaagcgctaaaataaattgcaatgatcaacgcattagtgtctttcaaagctgctgtcagcatccctgctcgttccacaaatgtctttgtacctgtgaatccgttccagtccgcggcgttgatctcaatcttctccttgagcaagtagtcgacaagctggttcatctcgagaaggacagcaaggtgtagcatggtatgacgctggtcattctgcatcgagatgtggtgaagttcgtctccgttcctgacaatgttcatgatcgcagactctaaagctttgctggtttgggtcgtcgggacgaccgagtgcgttacactgatggacatcatctctgtcacaagccgctccagctcctcatcgtcctccaggctctgttcgtgagacagcggactatgggtggatcgtcgtctggggctctcagtcatggggttcagcctcgatcctccagaacccgaccgttgtgtagagacatcagaagagtcccgccgcatgcttccgcgtcgcaccacccgtgtggctcttgacctcaagtcgcccagccctcccaaccgcggctctgttctgtcgccagactcgttattggaaacactgagactggtccctgagcggtgtagccgtggttcgccgtaatcatcccatcccatcacgagaatctctgcgaccaactctgccaaaaccattcctgtcttatctgcatacgaaaattgtgcatcgggcgctgtcctgctgtgcagcacgttgctggagtgcttggaccgcatgccaaccgatgcaaccacgggctggatccttggtggcgtgcggcaagtcagcacatccgagtgaagcacggtgacattggtggccggcagggaatcaaaataaggcacgagtccggctatcatggcagaccgtgcaagacatggttatgttaggggttggttgttcatcaggtcggtcgttctcacctttgctcctccttataaaaaatgatctttttacctctaaaaccggacccaaagatggtcacctccgtgccaccgagcatgtcgcccacgtccgggataattcttttgatcttgggcgcaaccagtgtatcgttccatgactttgactttacgggggcaaatgctccatggccaacaagtttaggatctgtgggcgatggacctgggaatcttgccgttgttccctgagttgacaagggcgagcgactgtttgggctgtcgtaagtatccttgtcagcgatatggtggcgctgtcggggactgtcgatgctcatagcggtgggttcctggatgcgaggaatatggccgtcggtgtgttgccgcgggctgccgtaagaggcaaaggactgatggtgagatgagcgtcccccaggaaggtgtggagagccatgcgcatgggcatgggaccggtcgtgcatgtcttcatggatagagtccggctcttccgaataaaacgactgccccatgaccatggcaggaggcgcaccgatgatggcgtcgtcctcgggctttgcgatgcgtggcttgacatcgcccttgtcctcgctgaaggacgccatgctcttgttcttgtggttcccggtgaagaggatgtccttggtcctgcaagagcccacgcggatcttttggccatggagatactgcatcaggctaaacttgaagctagtggtagtacatttcggtttagagttcaaggtgggggttagcaacggcaaaagggcgtcctgactcaggtgcatgcgggcgcagaattatgcggggagaaaaggactatgaatccagcaaaggggtacagaactcacaagtagcgatcgttgttgcctcgcttgtcgtggtgggtcgaagagcaaagcaccttggccatgacggtggaggtcccgtgtgtaaagtccacgacatgatcggacacacagaactgcaggatctgacctggatcgacattatcgttagcgccatgcgcctttgagggcgcgcccggtccgttggacggtttcctcactttggcgtcgacctagcattggaagaaggtgtgtcagaatctcggctcagagattctcaagacgcctctcatgcgttctcctcgtccacagccgccttaccttgtgacagcactctgggcaggcttgtacaatggcctctgaactagccaggtgcacagtcacctcgagataaaagtggctctctggatcgcctgtcagagcatccggtatatctggggcctgcggcggggcggcctcgagggtgctgttggctggtgatgctgcggaagcagcgtctacagagagggtgtcgggctgtctggccttttggtgtccttggatcatcctgcgcggcaggatcagcgacatgggacttttgaaaggttcgcttggcggagaccggagatccagcttgatcaagaactgctgccccgtccggaacgaattggtgtcctggttccgcttgtgaaaagttgctactgtgagctggtattgtcccgaggcaagcacagcaggcgacgactgattatgacctctgtgggatgaaagggggaaaacacaaggcggtgccgttagccacagcaacaaaaaaattccattcctcagaaacaggagagtaggggggggggatatgaaaaaaacacgaggggtaaaaggggacgggcaatgtgcacaggcacgtagataatggatactgcgtcgagccgcgcagtcatcattgcttctgctggagccacttcctgtttgcagctgtttcctcttggcgcgcttgtcgggctgtactgtcctgtgtgtcactgtggaacattgagcgggcgagagggggctgaaaaggggtgctgagcaggaggggtgcgcgacgtggccgtggacagaccgtttgggacaagcacaggcgcatccggtcgaatgtcgagacaaatactgtcggctctcttttctctcgtccgtgtcccaccagggctgaacgggatttcttgtctttcctgtctccagagcactgagggtccacaaatgcgacattcaaaaagagcacttgcgtgtgtgtgttgtgtctagctgtgtactagtcgccgcattcgccccctgttctcttgactccccacccccaagtttccttctctcgcacacacacttcatattctgcgctaagacagccaagaaaagaacatgggttcaccagtgcaaagagacaaaggaggatgagacgcaacgaggagatgttgagataatgacactgtacctgaagctgccgctgctgctggccatggtgtgcacatgactgtggctattgctgtggctattgctattgctgttgctgctgctgccgctgttggttctgctggcattgccgttgctgtgatgggcctctgcgcgttgataggcactgctgtagtctgcgctgtccagagacattgcagtgtcggcccctggtgctcctgagacggcggctgaggccacgtgctggtgcggatcgtccgcgagcgatgcttcgctcattaacgggctagtgaccaagaagccttgggactcttggtggttcaggataaactcatgacccggcgactcgggctaagggcaagggaacagagtaaacagaaatacggcgtgagttgcgcgacgttgggccaaagaaaatcatgcagagtgcgctttcgggaacggaaaggggcgttgaggctgagtgggaggtggcctcgaggacgagggagaggggagggatggaccaacccatggagtgaaggatccatcccgagctgacgtaaagggagggcggagcagaaaaaaacgatgtccttggccgtatttcccgatgaaggttgctcgctgttggtcgtttgttcactctctttgctgaatggcccattgctattaataacctagccggtgcgcacacgcacgtcggctgtgggtggggcccaaggtgaacgagggatggcatttttttttcttttttttcgttagctgtggtatagtggctaaacacgagtgtactgcagggcgccacagggaagaggaagacgaagtggggctccagctccacaagggcgggcgggcgtgaacacaacaggatacaaagacattgtccaaagaaccatagaaggagaggattgtccatggggacgccagggtgtttacgtactgcaagggtgtgggtcggaggaggatgggccgttgcaggctttgtgaatgttccagcggcgctctgttgatccagcgggtagtccgcctgcggatgggcgtccgatgccattcaagcgggagcacgagataccggaggtcggaagcaggagcaggagcaaaaggcgggagtaggagtggaagaagaggacgaagaagttgaggtaggagagagtgctggtggacgtgtgtctgtgaaaagagagtgggggtgagcgagtgagtgagagagtgagagatagtgagcgacgggaagaacaaaagaaaaaaaaacgaaaaagaatagagtgcgagggcaaaagagtaaagagatggcggtgctgttcttttttgttattgttgtctatgggagggttatttcgatggacaagcgaggactcattcgaccaagagccatgcttgtttgcgctgttgttgctgttgctgttgctgttgttgttattgttgttgtcgtgtgttgtgtgcgtgttgtgtgcgtgtgtgcgggcgtgtgtgaaggcgtggaggggtcaatgaatgtacacagcacgaggtgccaggtggagcagcagaggctgacgcgtgggacaaaggacggctggcgagagagagtgtgtgtgtgcgaatggcaatgcccgtaaacgacgaatagccaacgagggtgaacgacgaagacgaaacggaaaaagacaaagacgacaaagacgataaagacgacgaagaggaagaagaagacgaaggcggcagatgagggggagggagatggaatggagatgacagaaaagagtgcgttttggcaaaggtgagaaaaaaaagaaaccagaacagaagagagaacaagagcgagagagcaggtggagatgatggctgtccctagtgtaggacagtctgccgctatttattgtgatgatgcgtggatgggtgttgcggcctctgggcattggctggaaaaaacttgtggctgtggctgtttgcgccccgattcgcgaggttgcgtgtgtctgtctgaccccctttggcccccatcccgggtcaaccatactgcagacactgcactgcatctacagcggatgcatggatgcatgccatccctctttctgtcgtttttctttctcgacctgcctctctcttttatccgccatccgctgcttcccttgcatccaacacatctgccatgcgtgttgcgtgcatcgtgggttgcggcgagtcgatcgaacgaaataaaacaggagctgcggcgatccaagtggcggtgagctgtctgctcgtgagagatcaattcatttatctcatagtgtatttgggtttgcgtgtcatttctgtgcgcctctcgaaagaacgtttgggaaaaaaaggagactttcgctaaacacgcctcacctgagccgcggattcagatttgggcacaagcgacccttgatgaacaaagaggtcagctatagctttgccatggcccacagaaacaccttacagcgatggggaaaagagcacccatttatgcatcctgcggagctcaaagagagttccttggaaggtcgtcaaaagatatgtaccgttgggtccagccattcagcgagcatccacgtcgttattctacagccctcgcacagtgctgtacatgggcaaaggtacatcgcatagacgatgcagtaatagaccagtgaaatacagccatggatgcagttgacagctctgggacagagcgggtggtctggctgtcaatatcttgacattctggtgtcctgcaggaggaccatggaggccatgcagctctggttgcaagccagccctaatgagacttgagagcacgccgcatttgggagggggggggggccaaggacgaggggatatctcaccactacatgcggtgtgtgtaggccatgcatccggcgtcttgctctcaacccctcatcaaatcagtctgatcgacaaccaagtggacgagagcgcgcgctgtaagcttcaagaggctgcgagactatatttatagctcgctgagagacaggatgacggttgccttccaaaagtactttacttccagccagtctccatctctcgacagtgggtgggtggtgttcgtgatggctcctagagcgtgtgggtcgaaggccctgtcaacaaggccaccttgcagacgcgttcatcgtcctccgatgtattgcgctgtacgtgtctctacatcctcggcattcgtccatgcttggagcgacgcgctgtccacaaggtgattagggcaagcttcatgggatgtgctttctgttcacacacacgcgcgcgtggttgtccctggacaagggacaagggacgcgacgccaggcctggccagtgcttgcagaggtgcggaggcgcagaggggtgagaggaggaacaagacgaggaaggatcaggctacgcggatgatgggagatggagggtgtaggagagggtggccagcagcttcttggagatgtcttttggcgacatgcgatatctgtgaatcgtttgtttgtgtttttgttgtgtgagtgtatgttgttttttttttaattttctgcctccgcctctcccccacccatcactcactcactcactcactcacactctctcttctcttcttctctcttctctctctctgcatagtcattctgtctccgtcagtctcgctgtcccccaatctcaatcaaagcaccatcccatcccatcccgccatctctccatcgtcttcttgctccgtcctcgctgtccctgccacacatcccctcgtccccccctggtcatcgctgccctcgcccgccgactgctgctgcctgctgcctcctgcccgctgtccccatcgccaccaaccgttcgtctgcgctggctctctctcgctctccttcgcccctccctcattctctcgctctctgactctgcgcacacagcggagatacgtgcttgtgcgaccctgttaaggaacagtgccctcgctactcctcccgcctacgtctgcctttgcagtcgctctcattcgcgcacgcgtccgtaccccgcctcgcttcttgtcctgcgcctgcagcgcctcgttcgtgcctggtccgtcgctctcacagcacatcctatcacatccagacacagacctatggctgctcagccttaatacaactgcgttatctctgtacctctcccctccgccccccttccctttcctccgctgcatcccctccccctccgcacagccaacacccatccatccctggcatctgcgcgagcatagaaagtaaaaaaagaaaccaaccgggcgaaaggagcaccggtccaatctcttccagtgctggaccttccttctcacgaatcaggtatgcacgcagatcggaattcaactgcactttgcttcgccatgcatcgcatgccgacttgtgttctcaacggaaaaaaaaagatctttttttttttttttttgcattcgggccacctaggataagtagcatgccgacgaatcctcctgtacagacgcgtcgcggaagcacacggacacgcaccaacgccctcaatgcgcaagcagcagcggcttcatctaaatcaggattaatcactggcagcccagcaaatacacggaggacccagcagcagtcgggagcacagcaagagagctctgcagttgcggctagaccaggacggcctcggagagaggctgcagcactggagaccggggaaccagagcggctcaccaagggtcgagctaaatcgtcaagggcgagggagcagactacttcgaccacgccttcccagtccagatcctcctcacaggaacgcgatactcactcgcccaccccctcgtcggcccatgatgtcagcagagacatggaagacgatgagagggggcctcgggtgcggtccgtgtcccccacgccaatcacacagcaaagaacgagtgcgccacggcagagtggacgtcagttgagcggctccttcaaggaggcggaaccgccacgggggggcatcaatctcagcaaaaactataagggcactaagggcagcggtagcaaaagcattcggaatggcagtagcgctagcaagacgcccgaaccaaagcaggggcacaacggatccaactcggtcagcgaggaccgcgatatggaaggcgcctcgagcgagtctggcgaggaagaggacgatgtggaatcggacgaggatcgccaagggggcaaaggatccagcaaaactcgcgccgtctttgcaaagacgccttccaagcggcggctgagatccaacaaactccaacctagcgtggtcgcccacctggctgtggacgggagcggactggactttgaccagatcatggacgagtacacggaggagcagcagcagcttcaagccaacaccagtgctgccgaggcattggtacgcctgcttcgtcaaggcattcaagactcggaaagcctgcatcctgacatggtggacgatcatgactatgagctcatccgtcatacctttgggggtacgcaaccttctcccttttttttatttctgcacaagcacatttgacattggcgcggtgatatttgtcagatactaacatgatatcgttttgtgcctatagacatcgaggacttggacctcagtctaacaggggccatgtctgcgcctgacgagagcaatactgaggatgatgggcttacaaaggatctcaagagaagacatcggggtgcgaaaaagggtctctatgatgtcgctgcacaatacaaggcggctaaaacaaggtgagaagtctgcagcagagtttttgccagcggtcatgtgtgccatcaggccctctaatgtcttattgttcactttactttatctctttagaatggtcactcaaatgaagaaggacctggatgcagaggaagcacagatcaaggctggaactcatgcaggactactcgctgagctgcaagcgatcgaagacagacgaagagcacggataagaatcatcgaggcggagcgagactaccgtcaaaagatgtgggaaaacggctttcaggcggtctgcaaggctgccaatgatcagtaccatgtacggagcatctttgtttgcttcctctatgggtcgtgagcgccaccaaaaaaaccaaaggcgtcacgggatgccttcgctaacagacttttgttacattgcgtcgccattttgactaggctggacaagtggcagccaggaagagcatcattgaccttgtccaaagtcgaatgaatcggatccgacacgagctggatcacagcaaccgcgtggcagctagatccgcagctaggcgtcggacacatctcatccacgctctaaagtacaggaagccgacgctgatgaatgcagaagaggcgtccgcgtatgattcgtgtgtcgagagctgctccagctacgactcttactcgagttcgggatccgagtgcagtgattgcgaaatctgcaagatatccccaaagcaaaccagcgccaccaaggacacattgctgcgaggactcagtcgcaaggaggtcgcactggatctctcctttcttttcccgacccctccgcgtgccttggaagattcttcagggtggtctcggcccaatgacgacgatctggacgacggtcctctacggggatccagcaaaaatcagcaacgtatgattgaccgcttgaatgacgagaagcgacgacgaaggcgcgtgtcggaccgggaattgcagaacaaggctgcatttaaaaggcacgttggcgctgaagtcatcgcgagcaacaatgatatggatctggatccggagctggagacggatccccgatccagatcaccagcagtgcctagaggaccagggcgaccctccacgggcgcgacacgccatcggcaggcgaaggatcatcaaccgcgattcctgccaggttttgggcccgagggcatccggcgcgacgacgctccaccaaggatttcgtcagcacctcagccagcatcccgccaaaggtcaagatacccaaatttggatcgatatggccaacgactcgagtccatccatcgaagctctccaggctatgccagatcagaccgaaacgacacgcgcgtccctttgatggacaggggacgtagcgggatgcatgaacctccgtcagcccaggatgcactttatcaggattcgagcgagaggcgcccaggacccactggaagccctcggcatcatccgagccagccggtgaaccgccatcaccaggagatgaccgatgggccacctcgttcaaaggtcgtctatcatgagccatcaggctcctatcgctaccatccctacggatccaacgcccaccctgctgaaccacgttacgcttacgaccatcgccctgtggatcatggaccgccgcggcaacgagggccgccgccacccatggattcaaatggatatcaagcaccacctcgaggacgaccgttaaagaacagcgcctctgtggtcgcctggtcaggaccgggcccttatcccggcgctgttgatgcgccgcattcgtcgcgtggtgaggcacagtttgcaaaatacgagatggcaggagctgccactcacgagcgagcaaggccatcgccgccgtcgttgtcatcttcttcagcagcgaacggctacggttcctttgaaggtccgccccgttcgtcccctgccatgtccaatcgacttgctaccatggcaacatcgtcaccatcgtctttgggcccctcacggatgcatgccttgccaaggcatccgttcagaggaggggtagcaggagcaggagcaggagcaggagcggcaggaggaggaggatctgcgcaaggcaacctgactcgatcacccgtcatgattgacctctcaagcgacgaccgctcaccactcatggatggacgacgcgtccctgtcccctcgggcgtctctccatctacgacgggtcgaccacgaacaccgcttcctttgacagcgtcgacgcgcgagccatcgagcagtagtagcagcggcaacaccatgaagggacgaccgaatggcgtggctttgatggcgactggaccagcacggctgcggtctccggcgagggtggagattgatctgacggacgatggcgtggacgaccatggtggtggtgggtcctcgagaaggatgcctatggaaggtggctctctgcgccaccatgcggtcatggaaggtccagccacggcatcgacagcacccacagcatcctccacagcgtcttcagtagcaggagggacggccgcgacggcggagacgcctacagggtcggcacggcgggtgcttcaggaccctcgggactccgaagtgcctgtgaggggtgacgaagacgtccgtgttcccgaaaaggacgataccgtgccctcctccgcctccgcctcttcctccgcttcctccatgccggcagagagtgctatgaaagctgaatccgcgtaaaagaagataaaaaaataaaaaaaaaaaactagcacaaaaagaaaaaaaaaaagcgcgataatagacgtattttttttatttattttttttcctttacagctgcgagtccatgaagcagaactgatcttggatcatatgctcagggctgatgggcgagaccagcagactgagccagaggtgcatgctgagcatctgttgactgacgctcaatcgatcctgctgcccacctccgctggccggcctcgagcgtgctaccatggtcgtcaagtcttcttcctcgccaccagctcgtccagctccttcagctcctcctcctcctcccagggctgttgtggccgaggctgtaccaggggaggcaccgccagggagaagagttggggggatggtattgttgacggcgatggccacccctcctcctcttgcagggctactccccaaacgaacaccttcagagaagcacacgtgtgtcgtcgccgcatgagcagcagcagcagtagcagcagtggcagcagtagtagcagtcgtcaaagtggtagtcgtaccagaaagaggaagcgagtgagaaagtcgcgtcggtgagggcacgaccgctcccatagccggtgcagggggtgtacgcggggttccaaacatgggactggagccgtaccgactgctgctgccatgaagggtatgggtgtacgcagcattggccagcgtggtggcaatgggtttcagaatcggtcgtggtcttgatgatgacgacgacatggatttgttgggcaacagacagttgttgggcttggtgccagaacccgttgcggtcgaaagaggaccgttggtcgaagagagggagaaggaagaggacgacgatgcggtgggagagttattactgctgctgctgccgctgccgaagcgatagccggaaccgaggacgacttggatccgttgacggtccacccaatcctggacctgacgatcttcttggttcagctcctccgagaagcacgaccgtgctgctgtggaccattgccggacgagtctggggactttgctctcaagcgtgagcagctgctgcatcagacgtcggtcctggcggacagacctgtccttattgtgggtagagttgttagtggctgctgctgctgctgctgctgctgtggatcgagcgtcctgtgagggcaaaggcgtcctcttattcgaaaccgtctcttcctcttcgtcctcctcatcctcttctgggatcgaggatgcagaagcagtcgagtgatcctcccccatggcagaacgcgcagcagcgcgtcgttgctgctgttgtgcgcgcgccagacgggccagtcgcatcttgtgggcatagatatcaggtcgaaagtctaatcctcctgttgaagcacatgtcgtttgacttgactttttcccttgctcatgctgctgctgctgctgctgctgctgctgcttttgttgatgttgacgacgagcggtggtggctctagtgttgagaaagtccatggtccaggcaacgtgcatgggtcgcagaaccgagggcaagggcaaactgacagcacccagaaaacagagctctcgaggcagaggcagatccttgacgcgatgaagtcgcttttgaatcaggtctgcgaggaccttttcggaagtgataagcatcggatcagagcaagaagaggaggaggtggaggaggagggagcctgcatgtccaggggcgctggtgtcgcacggtcctcagggatgtcatcgcaggtgaagacagaggggaaggtgggtgagtttgcagtgtcgtcatgctgaaatttgggggggcggatcgatttttgacgcagggctttgaaaacgagttggggaaagaggttggcgagcatggctgggtaaatgcgttgtgagggtgcgcctgtgctctttgtggtggtgctggtggtggtggtggtactgctggtggtggtgctgttggtggacgtgacagaggtgtcgctcgagtgtgtggactctgtagaggaccggcgcatcgcctctccacggcgattctggcgacggctgcgactggactgacggccagtgaccgagaggacaccgaaatggaccagttcatagatcgtgtagcggccttggacgagctgtccgtcgcaggtgatccgataccggccaatctcacggatgttgttgccaaggatggcgcccaggagcgcgagatcaagcacgccttgagggccaaagctacagagggccgtctttcgcagttgagactcttgacggatgatggtcatatgggcgtgggaggggaagctggtagtgggcttcgacatgctgggtatagatgttggtggatgtctgttggagtggtggaggtgaggtccaaggaagcagtaaagaaagaggtaaagaggtaaaccaaagaggaagtcaaaaaaaaagaggcgggatttttctggctggaatgaagcctgtgggtttttaagttggcgatctcgtgttagtgacgagggaacagaagtggccacaaaaaaaaatcactcgcggcacaatcgaaaaacgggtggtcaggatcgaggaatgggcttgcagtcaacagtgtcgtatttgtactgccgaagaggacggatgctagagcgactggggtggtgatcagagtgggtaggcgactttgcgaagggagagaagagaacgaagagcgcaggaaaatgttggcgagctattaaaagaaagagcgagagagagagagagagaaagagggaggaaaaaccggggtagggaaagtaagggctgaaggaatgactgttgccgcgacgaagaggggagggggcaggagggggatgagaatacaactatttttgggatcagtgctcgaaaaaaacaaaaagtggaggaactggacgggagcaaatgatataacaaacaagttggtgacgaccttgcgtcggcttgctgggaatagaaatagaatgatgatgatgatgatgatccgataaaaaaactgtcaacgcgagtcgagagtgaactgaagacgcagtgggaccagccgacgtaatgcgctctgttcactggggtgtaggatcgcgttccagatacagagatgcaatggcgatttttcaaagcacctcctaaatgcagttgagcaggtggagaacaacagtgtagcgtaaagggagcgggaagaagtagcgaaagaacaaacaagacgagcaaggaggtcaggggtgatatataggagagtgcttgagccagtgacggtgcagctgtaggtactgcgagcaaagtgatccggtacaatggatgaggcaaaaagtgtaaaaaaagagatgagagagcagggcgggtgttgaagaccttatataaactcgcacaggtacatgggctaaagtcgtactactactactactgtacttgcactacagtatgcaagtggacgtctccagcaggttgaggaggaggtgggtgattgtctcgcgcgcgtcccgtccctcgtcctcactcacgcactcactcatcactctgcttctttggtcttggttttattgcaatctactatcgatatcgcataatctcccgacaccatttcgcaacggtccgcggctcctcgctgcaatgtcgatcgatgcggtggcaacccaggtatgtttgatctgaaacgagccgcgaaaagagtgctttggtcacactagacagggcgaacacagacatggacggatgctagcgcgaattatctactgcacgggaaacactttcgatcatgtcctgcagccgacatgaagcaagcacggtcctacagcgagcccctctccttcctcaggcctctgagagcgacatgctggatgaatagaagagagcagggtcattaaacgaggagccaatttcaggagaagtatatgaagtttcaaaattacatattagagtttggacactggtcctcctcccagttccctctgtccctcgcggtctagccgccgcggtgatggttgcaagccttcatgatacagtgcatcgcagagggcataccagaacatgcgctcttggactgaatggacgatcggaggttcgagaaaagagataggtgtcaaggacggacgtttgactcgacagaattagcagaatgagcagctgctcattccatagtcgacattcgcatagcaagttgtaattcgccacagcaagacagcaagttgacagctgcgcagagcgatttcacagcgttgcccgcctgcttcgcaagtggtgcttttctcacctgcagcatccgacctcagaacgacgaccaaatgacatctagtcgttgtatctaccttgtcctcgttggactccgcgcacggtatagttttcacatccgtctttgcagaaagacagcaaggagaataaaggcgcgcgttcgccctccgagcgcgtgtctgacgcgtatcgcttcttactttacgcctcttccctccaccttcaactcatcctctcagcggcacacatgcatggacgttgtagtgcagtgctcgtacttcagtctcagccgtttcagtgagatgagctcgatcatctacagatttatgattcgtaaaaggaacttgaaagtggttatctatagcatgctctcactaggcgtggtcaaggaactgctctaaatcttggtacggcttgctatcagcagtcgccagtctgagcgaagtcccatgtgaacatgcttgcgcggaaaaacacatacttacccctgacactaggcgcaccaatcgaggagcacgaatcgaattttttaaggctaagcccaagatatgaaaaggctgggtctgcaagcagcgcgagatgcacatgtagtacggcatgtcccgtatcctcaggaccccagatgagtttgaaaactgctcattcatcaagcacacccgcaggcgaagcccgtgtgtacttcttggcttgctctcctcgaagcactgccactaacaacggtctagtcattttcctatgagcaagggcgacccaggttccgcgcgtggttgcgtaactccacggcttcgaggagaacgtagcctgcattgtacatccccagaagtgaggtcaaggctggtccgcagactttaaagtcggtcaggacagcagcacctacagcagtgatgtgcatgtataaaggtgcgcaagtatgtagcataatcattcatcgctcaaaagatgctgaagatgagagcattgaacgggctgagcaaaaaagcgtgtctttcattttttttttaaacaaacacatactcagcattgatccatcttttttttttctttcacccttgcccatcccttgtccccatccttgtccctcatcccctccccatgtcccagctggttcccaatcacttcatttgcgtcgttttctcgtttttttttatccccttcccttgctcctcttgctgctcctgcatctcttggaaccttgcatgccctgccccttcagagcgcgcaatccttaagctactgcgacatgcaaacggacaaccaacacacctggcatggcaggaccgcggccctcgatgtcgagcctggttctaaccccgcctccaacttctcgggcagcactgcaagacgaccggctactgccgcgcggagctggagcggagacgagcgctcgtggctgctgggacctcgagtgcgagaccgcccgcctacgagcgctggacatggtgcatcgggagctggttctggttcaagggcggccaaaggtcgccgcaacacgtggatgttcaacgcaaacaaacagcacccctacagtatcctgcccacgacagacgtcggtagcgatgacggtgctggtggagcggcagctgtcgatctgttgaggcgaaacacggtgaaagactttccgggccaaactacgtaggtgaagcgtgtttcgcatgccatagcccaataccgtcatgaatctaattttaaactttcggattctcagggatccaaaagaccctctcaacaggggcgcgtccactcttcgagggcctagagacaagtaagcggcatctagcttagcatcagcaaccacttgtctccaccgctcagcttggcttgaaatgctgatattcttattcctgcaccggttagcctcacgaggcatggctcttacaggagcgtcatgacgacttcctcgttcgtgaacaaaaactcggcctcgatcagtgcccgccgaaatcagctccaccgtcagaactccttcggcgtgagtcctaaccggtttctctcgttcgcttatcgactgagagagctgacaagctcaacggacactacggacgagaagacaacctcgacagtgctggtatgtatttggattcaggcacggactcaaaggcgaaacaatcaaccaacttaccaagaaactttattttatcgttaaagaacgttgtcaacgtttttgtagacacgctcttctgcacactttaccttgtggaagccagcagcatgaagcggccagatggctatgaatcacgttggctatacatcgagaggacccgttcgttctggcactttctcgtagcgattgcagtctacaactttctcacggtctgttgcagcattctcttctcagagtccaagctgaacgctgttcgcagtacaaggcacatcgtctctactgtgattgctcttccattcatcttctcggtgcttattcgcgacggccacgagatctatgtgccgtactttttgcagagtttgtccttggtctccagggttcaacaggcactcaatttttacatcgacattggcgtctcaggtagcgttttcatgtcgtttttctctctacgtaatggtgctcctttcacgccatttaactatctatcactgctcgctctctagatctgcccatggacccattaaagtccaagtccatcatctttgccatgtatatcatgactctgatctactgcgccatttcagcctttcaagtggcagagtacgatcagctcttgctatccggcgaccacaacaacctcttgaagctcctgtactttgtgctgatcacgatgagtaccgttggatacggagatgtcacgcccaggaatcagtttggctatgcaatcgtcatccttttcatattcgcggtgctctcagtactcccttggatgatatccggtattcaggatgccctagcgcaagccaaaggttagtgagtgtacattgatcgctgtcaaggctgtattgatgtttacgaaaagaaaactgagaacgcaagcttctgcttttcacacgatagctggtgagggcatgttcgagtcgggaggaaacaagttcatgatcatttcggggtcattacactctgcacaaaagctctccaatgtcctgaatggcttctggttcaccaacaaggttcgttcatcgcttcaactttcaaatttcacagcttcgagagggccgcgtgatactgatcttgtctgcgtgtttgcatatgtttgatgctataggaatactctaattcgtcgttcaagattgttatactgggactgagtgagccgtcaaaagatattgaggcccttcttcaatcagcacgctacaagaatagagtcgtctatctcaaaggaaccccactggtactgcatacttgcagatacaatatgtgcacacgcgaaggcaagagacgaaggcaagagcagcttcaaacccacttaccatcttccatgtgatgtacaattcactattaggagagcaaagatctggagagaatccaggcaagatatgcagagggaattttcatcattgccgacagaaactcgcccttttcgccccaggaggaagaccgtcacaacacgctctcgacgctggcattccggaatgtgagcgatgctggtatttacacctacaatcttctcccagagtcggagatctaccaaaagatggccgcaacgcaggtggtgtgtgcggacgagctccggcaggtcctcttggccttcaactgtctgcaacaagccaccgcgaccttgattttgaatatgctgcaccagcatcgaccatcggacaatttcacagaggcatgggaggccgagtatgatgacagtctgggcaacgagttttacatttcgtacctgaatcccatcttcgatgggaagcccttcggattcgtatcttgggtaagtccaaaagccctattctgtcctgaccatggctacatgtgtttgttagcatcttggactcacaccatattactgcttttcttatcaagttcctgtaccgtcgatttcaagtcgtcttattcggggtgcgcattcgtcttcaatcgggcgagtatcataccgccttgaaccccgggcgcgattaccggttccagcacaacgagcagtgcatcttcattgctcagaacccgagtgacctggacgacattaacgaactctcggaaaagcacctggagaactttctggagcacttgcagaaaactcagctcgaggacaatgttgaaattggcgccgactatcatgccaaaagcttttcacaggcgcttcttacgctgtcgcccaagcacggatgcagcagcacgcgcaggaaaacgggatcgacaagacacatggcccatgatcagacgggtgctccatacagtcggcggtctgggcggtatcaccttcattccgcaatgccaacaatcaccaacgaggacgatgacattgatgtagagccagaggtcagcttcatgtctgggccggagaacagtgacggagaacaaggcgcgaaagaaccgcgctcgccatccatcccaactcccaaagcgactccagacgctcaaccaacgtcgccacgcgctagtgcacctaagggcgagagaacggaggcaaaggctggtttcaggcggcgaggttctcacaaggccatgggcaagttgaggctgcagggtcaggatacctccaacttgctgattggttacccacccgccccctttactggagcccgggcgccgttatgtatccttgtcgactcacggaatggcggcgatcgaaatatcaaggacatgatcatcaccacttggtctgacgtgcttgaaaagaggcaagtgaaggccagtgaggcggaattcgacaggatcagttcaagcattccagaggaagaatcgtcagccgccgaggcgaccaccactgggacctgggtcggggatgaagctgatacccatctcaagccagtgtcagagccagctcacatcctgatatgctcgcccaactacgacatattccgtctgatctgcactcttcgatctgcgcacttgaagcagctgcaggacattgtcgtcctctgttctcgtctgcccactgagacagaattcaaagtgcttaaaagttttccgcggctctactttctgattgtaagtactgaagtagtattattggcactgtgaggtaacctctcgattttcagttatgggcgggtgctaatgatccttcgaaatataatagggagactgcctgtctcgagaagatctcgagcgtggcgccatcacgaaatcaagcaagtatctcttcttgcggcatcctgagaacgctggcgtggatggctcgtttttcgacagcgtggcagttatcaacaggattctggtccagcagatcttctcggacgcacagatctccagagtcagccgtcgcggatccccagacgacggacgtgcaggaacccttccgtcgacaggacctagtgacaacagcattttcgatccttctagacaatcgaccttgaaaccttcgactttgaggagatcagtgtcttcacttcagtcgttggtagaggggcctcagtgtgtgtacgagttggtcgaggagcgctccgtagagttcttgcagatccgcaagacagacatcagcataggccgagatggccagagtagcgcgggagcgagacctacggttttggacggtgctggcgggcccctcgagccctttgggccagagacggactctggatattatggctttccagagcaacaggtcaaccagcgaaggaaggtggcaggtcctggagctgcagacttttatcacaacccgatttatgcctcgggcggtgtgctggtgggaggcctgttggaccatgtgctgtaccagctctattcaaacccaagcatcctccagttgatcaagctactttgcggcattcggacgagggcggatgtcaagcgcgattaccatcttttcaagcagcattctggcggatgttatctcgagtgcatccctgtgcccaaggggtttggtgtcgagacgattcgtccgtgtaaggaccacggcgaggaacagagtgacaacgcgggatctgatcacaagagcagcagtgacgaggacgcggaccaaaatggcgctgacaggagggatcgtaagcggaatcgtcacaaaggcacatcatccttctcaagggcggcatcgaagggtaagcaaaagatctctgagctattccagcaccaacaccatcatcaccatctgttgtgcgagcacaatggcagcggcagtggcggcagtggcagcatcgactcagactacatgtacgacaaccggcacaagaactttttgcacctgtacgagcacttggccctcgaccgaggtgttatacccattggcctgctgaggctccaaggcgatgatcccaagactgtgcatctgggcattggaggcagctccagatgctatgccattaccaatccactgttggataccatcgtcttggatacggatcaggtctttgtcctcacccgcgggagcgatgcctaatggacgcgaggcttgctctcgataaacttggcccgcaataaaatggagatgcgattgtttgcgacgtccctgtgtgtagtatcgttttttggctgtgcatgggttgaccctctttgcaatatgaagctccatatttgacctctgtaagcaatcgccactattattggaggcctttccggctcgcagacgttgtcaaggtcgattggcctcttttattgggaagatgtgctccttggaagacgggtatcgataaaagaggtgagcattggaggcgatggcaagctgaacgacgctcagtgtagactagtagaaccgaggtctattggtgtggctctccgtatcgcgtcttcctgcttgagtccaccgcgtgccaccgtatccacgtgaaagggacaggagggccctgtcacctcctgctcctgctcctgctccacctgaaggtacctgatactcctctcttgaagccaagttttgtacctggggcaatcgattagtgccactgtaagacgggtaaactgaggaccgttgctgcccatactcttggtacggttgtgacgagcgttgctgctgatgttggtagccttgttcttgatattcctggtgttcctgtccatgaaacgcctgtgcattctgttgacctaggctgtactgcaggttgttatgttgtgattcgattcctcgctcttgctcttgctcttgctcgtcttgttcctgggccatctgctggttttgatcaacttcgtcctcgtcctggtcttggttctgcttagatacagagtacacggatgactgaaatttgtgtccagagcgtatgttaaaaagcggagcacagggctaggggtagatgaggaaaatctcgatcgtttcaacgcgtgttttctccagagagttacagtaccttgaagagggtgtagacgagacccatctttcgctccacggtcctgattttatcaatgagttgggcgacatccaccgcgttcatttcctgtagtgttgcattgatctatcgcgacgtcgtgtgtaagaaaggttaatgggggtggaggcgaaagggctggctgatttccaattgagatctgggttgcgagccacgagacgtggcctggtctttacatgctccagcttgacggctacttttgtgtactctccgaggatctcttttgaggacatggcttttgaggagagcagaggggtgctttgggtggtggtggtggggggagtgaggaggaatgtcaagcagacgcgagtgaagcccttttttgtctttgcaaccgcctgcactttttcgtttctggcgttgcaaagccacttgatcatggagatacaagagcgagcacttgcgcgcccaagcttctcatcccccgccctctcttttctgcctcctcttctcgctgtcctgtcttcccacatcccatccgtggactcgagaggcatgcagacctcgttactcgccgtgagcacagcactcaaggtgctgctcttccccacctagtgagtctctcgctctcgctctcgttctcactcctggaccgcgcaacgcagtcgcaaccaccgacgcgcttcctcgctcccagcaacacgccttctcaccacccgcctccattctgcatgtagccactccacagactttgaggtccatcgcaactggcttgccatcacgcactcattgcccatttcacagtggtacctcgaggtaaacttcatctcagagcagtgaacccagctgaacgtaaaagtgtcgcgctttacgtcggctaacatccttgttcgctaccattccaaagaaaacaagcgagtggacgctggactaccctcccttctttgcctggttcgaaaagttcctgtccttcttcgcagtgctcgtggatcccaagattgttgacgtccacaacctgaactatgatacactggccacggtgtactttcagcggacgactgtcattgtcagcgaactggtcctcttctgggcacttcagaggatgttaaagaccatggggaaccggccgctgcagaaaatcatcaactggtcgttgatgctcaaccccggtctcatcatggtcgataacatgcactttcagtacaacggctttctctacgggatcctgatccattcgctggtcgatgcaaagcaggtaaaggaagctgtgctttgctgtgtctgacggtgctctacctatacccgtttacgtctattgacaagacaaacgggccatttgttttctttgttgcctttagggaaagctgcttcgatcaggcatcctgtttgctgcactgctcaacttcaagcacatatacctgtacatcgcgccatcgtactttgccttccttctccgcgcatattgttttgagaactctggaaacagcattcgaggtagatacttgtaaatgcttggcatggcagttattctgtagaaactagttcggtggcgctctcgctgattcgtgtattctgatctctttgttctcaatagcaaagtcctggttctcggcgtttagaccgctgcattttctggcactaggagcgagcgttattgctgtattctctgcctctctagggccgtttgttgctttgaatcagttacctgaacttgcaggacgcctcttccctttcaagcgcggtctctgccattcttactgggcagccaatttctgggcattgtactcatttgtggacaggatcatgatcttactgatcgcgaagacgccactgggacagtacctcaacctctcgctggacacagccgccctctcagcgaccacacgcgggctagtgggagacacggcattcggtgtgttaccgacagtgacagcacaacatacactcattttgactgttttgctgcagatacccggcttgatttcagtattccgtaatcctacatttgagcgattcatcgggtcggtggttctgtccgccttcgcttccttcttggctggatggcatgttcacgagaaagcgatcttgctctgcacagtcacgatgagtgtcgcgatcgcgaatcaaattggagcaagccctaattctggcgcgggagctggcgtgttgtcggactctcaaaagggaggtagcctcttgacacccagagatgttcgttcattcttaattgtcagtctggcaggatatattggactgtggcctctgttctttactcgtgaaggtgagctgcgatgatctacgattaatgcgctcgttttgctcgcacaaggtttgcatggttgtctaaccatctctgtggcattctcgcttgatatcacatatgatagagacaccgatcaaagtgcttgttacagctctttggttcgtgctggtcgccacgggacttgatcagtgcatacccaagcagctgaaaggatcgtcatcaatggaggccggaccttcctcgtcgcgatcgttcttgcgccacttcacagcattggagcgcctttacgtgcttggatgtgtccctgtgcagctctacgttaatgtgcttcacgagtacgtttttggtcaggagaagttggcgtttttgcctctgatgatcacatccgtttatgcagctgtcggtgtcgtttatggctggctgctgtactcggccgcgtatttctcttcgcccaagacactggataagaagatgcgatagaatgaaaacttttgactatttgaacagtattggcgtatctacatgctttctcagactcctttcaaggtatcgacattgctttattttaaagttcgtccttccccttgttgttgatcttcaggagctcgacctcaaagacaagagcagagttggcaggaattttggctcccatgctgcggtcaccataggccaacggtgctgggattgacagcttgcgcttctcgcccacgcacatgccacgcaagcccaggtcccagcctagattgattttcacacgttgcagattattgacgaggagacatattagaaagctgattgttcaaccttataattacacgaacgcatggaaaaggacagagtgagcaatggatatagcgaagcgcaagtcgtgttttacctttaatgacctggccctggccaagagtaaagtcaaaaggtccgcgattgacagaggaatcaaattcggcgccagtggcccagagcgtgccggtgtagtgcatggacagcgagtctccatccttggacttgacacagttggggtcagggtttctggccttgacacctattagcgaagaggagcaacgagtgggagaagcgacatgcaaaagttcagccgagcaggttcatcagtgtagagtcccacaggcacagagtcgctagaaccgggaaaaaggcgctgggatgtgtttaccaatctgaagctgcgtgggctcggtcttgccggcagagacctgtgcggcgaggaagaaggcagagatgatggcaagtgaaaagcgcatggttggaatggtggagtggagaagagccgtgaacgtcaggacgtgccgcgcgcttatagggctggttgcacgtgggggggactgtcgtgctcagacaaaaaagtcacaaggacggcttttctttcgcctcgctttctgtttttttcccttcttccccacccctccaccacccgtcgttgttgtcgcccatcttgctgtcttttcctcacccttgttctctacactcatcatcatgattcgcgacgactctgcgtaccaggcacaggcaactttggactccatagcagttgtcacagctgcagcgacagcgacagcgacggccacagctgatcccatgcaggattcctcgaagcgggaccttatcagcgaaaaagtccgcacagagaaccgtgagcgaaagaagagatggagagaacagaacgaggacaggagtaagtcccaaatcactgcctgcttgcaatgtcttgaaatgtgcttcgtgcgtgtgttcttcatgagtgggaggaatggcaccgtggttttcactttaggtccggaatatccacaaccattttatcgccttctgcactggcctttgcttcactttgcccagtaatggccgtctctgccttctctcgctatcttcaagcgctgtcgactctttgtctttcgagaaccagccccttccccctctgcccccctggagcatttgggactcgcctttccttgatagacagtcctccgttcggagaccctctccagccttttctgtgtttttttgtgtccagccaatattttttttccatcgaaacttttttgtgacgtgtgtttgtcataaagggctgtcacaatcaccgcccgcagagtggcgaagcccactcaatttttgttttttgcttctcagatcgctgacacctataccttattctgatcctaatttcattagataaagacaatgatctgcggtgcagagtcaacaagagggccaacaagctatttggcaaggccgagagcgaacacaagacccgctggattgaggaggagtttggaaaacgtcagatgaagcgcaaggacaaggagagacggaggaaccccaactctgcactggaccccatcatcaccagctcgcccaccggcaagccaaccgtttcgttgaacgagcagctggccctccatcagcaggcgcagcaggctcagcagcagcaacatttggctaccctggcacattctcagtttgacccctcgacggtcaagacagcgctggcgctgaatgacctggtcaagaagaacggcagccatttggatcttgctcaattgaccggtgtactgacggatcccaatcttgctcgtcaactgattgaaatcgaagccaacaaccccgtaccgtctgcctctatgatggttatgaacgctcccgccaaggccgaccacgagctcaagggcggccacttgatggatgctgattaccccatggacgcggttttgaccctgatgcaactcaacggtagttggaaggcataatattttctttctctctctctctcaaacttataaaaaggctaccccacttcctcccgaatccggcttgattcaagaacagcaatagcatcagcaacgtcgactatcacacaaatcacacgacagagaaagggtcctggacccttgtatatcacttgcttttgtcctttcaaacactttccaactcctctccctccatgacctcccgtctcatcgcactctccgctcattcaaccagttgtcgtttccacgataataattttttttgcttcattatctgcacaataaagtaatttgtaccatggctcgcctcttcgacgtgaggtagtgtgttctttaatgcaacagagggagggggcttaggatatggcggaaggagagcgagaagtgggacagcggctgcaaggacttgcggcgtgcgcagcgccacacacattttgcactttaagagagtcgaaacaaggacggcgcgttcatttttggaaaaaaaaattgtgctacggcaatcgcctggtcatagaattgtgtagtctacatgtagtccattgtttttttccacgttgtgttcagtaacaataaaaaaaacacatctaggttttaacaatacggctgatcgggtctaatgatcgcctcaagcgcctttagcgcgttttttcgaggggaggagatgtacaaaaacacaacgacgggggtcactaaacatggtctacagcacaggagaaaacgcttgacaatcctagcgtagactacaacttgcgggcgaggtcggtggcaaaacacccgctgaccatgatctgaaagtgcgcctgggcctggacaaaggcatagtgtcgattgtgcataggagggggtaaaaaaccttttacatcagccacgctgaaaagatgtatatatgttaccgagggttttacaccgacgctgaatgaagagcacgtttttgaggacgaatgattatgccatggacatccccctacgttgttactgtcgcagaagttgaggaagaaatgaaaaaacatagaaaacacgaaaacaaataaacagaggaatatgtccccggacaaatgttatgtttctatccgtagattacgatgtgcacacttggattagcctatcatccttttatcaggtcgagctcttcggctctcgagctcagtggatcgacgacaccagatcatccatgaaaggctcgctggaacaggcacgatcgattttttctccacggtctaaaacacccttcctttaccccgcgtgagagtcaatcttcctaaaactgcggagccgcgcgatttcatcagccaagaaattagggctggtttgaggcgatttgcatgatcacaagagcgtagatgaatagataacctgtaagagtgtgaaagtgtaaaaaaaataggcgtgagtgcactcataagcagagtgtcacagcaatgagaggtaaacttcattagtaccagtcagtctgcatctcgcttatcagtgtgagaccacagtttcccaagaggtctgggaagagccatctgaggcgccatcagccctttccactgcagttgaggatctgcaatgccgatgaatctcccggaggctgagagtcatcatgaatgtggcgggatgtgatagactctgcctcagagtccaaggacgatttacgagtaaaggctcccagcaacatgacgccttgccatagaatagacaacggctcaatgcacctttttttttttgttattttttttgtgcgtatgaccacgccatccatgcatccatgaagcatactagagtttaggttcaaagagccgtatctcccttatgcgcgccctcggttgagtccactatctagaatgtactacggacggaattaagatgtttgcgatcccgctccactcggccttcaatccgccttcttaccctttcacacgaccggcgctgtcacctcggcgaatactcacgttttgttagctctcttttgccagatctgtctagcccttcaaacagtccttcctctctgaatcgcgcgctgccctcgccactgctggaggcgtgtcaaggtctgacgttaaaattgagctgggttgcgggcgagggctaaagattggatgaagtataaaaaaaagtgacttttgcattcagggcaccaattgcagctgcggcagtttgccctcgacggatctggtgtctttttcagtggaactcctaccatattaaaaatctgcccctgccaagaagggcctcgccttggggtttaatcagttgctgccccaaatctgctatgctcacacccaaacaagacgatggccaccagccaaatggctgttgttccttttttgttgttgttgtgttgttgttgtgtcgttgtgtttatcctgtgtgcctccgcctttgtataacgcctttctttttactggacgagagcatttctcgcgcatctaccgcgggaaaggttccgaacttgcgcttctgtccaatcgctgccgaaccttggtctcctcccacctacacgcactttgtgcgcataaactttttttttaagcagtgctcgggatatttatcactgtgaatggtgactaggtaactctaaagaagtttgtctacctcgatcgtttcaccaatcgcacgcccgaagagcgctcttgtgaacaaaaaactttagccccatcaaacaaaaacgcgccctcacactcaactctgaacaagatgggaatgtggtttgattggccttgttaaaaagctgattgagagtactctttaacgcttattgcttatatccattaggcgtcttgcccacgcccaatggtgtggactatggtccttgttgatcgcattttgcgtgcgaaataatagggttcggtaggtccttcgttgttcctgggcagaatcttccataggttgggtggttcatgatgaccaacagctagcattcgacttctttcttagtgttgctaacctgctactgcattgtaggtttaaagagggccaaggaggatcaggtgtgagtacaaacacgggctttgtgtaaggttctcaggagcaaaggagacccaagtgggcgtcgattgttcagaactgcggtccgcagtttcgacatctatcccctctcagtctaccattattatatgactgaatagacacactatcgaacggcgtgtcagttgtgaggtgcgcccaaaggtcggtgcgcgttaggcgagcacactctgctggatcggttcaacctctcacaaatcgccaagctagccctgcaaaaagtagccattcggacatgttccgtgctggcactgtcgagggcaagagcgaaattcaatttttggacgtttcttgtgcttctcaatgttgtgattgaacacagacctcggttgggttcaaaaaaagtcatgctttcctcttgcatggcactcactgagagcagcaaccctcatgcgaccctcaggaccattcccaggaaaccctcttgaaccttggcgtccagagactcgcccctgagcactaaggttctcagcgccatagatcgtttcatataaagaggatgcgattctcaatcagctccccccccccttttttttttctcttttgttccttgtccatcacccgttgagaaccatcgccacccctcctcgccctccacgtccctcccatccaccgactccgactcttctttcgagaagttttcctgtatattttcattcattcattcttcctcatttgtatacctatatctctccttaatatccagcgctttcattcataatggccacacaagtcagcgaaaagacggagtacgacgatctccccaaggagaagtcctcctccattgatggtgtcgacagcaagatcgagctccacgaggagcaggatgagttcattgacgagcccagacagttcacagtgtatgtgtctttctgacctatttcgcagctcgccgttgctacagacccactcttgttgcgctccactcattttctaactctcttctgcatgctctctctctctctcatgatcacaggcgtgcggttcttgttggatccatcttgggactggtcgtcgccgccagtaacatgtacactggtctcaaggccggatggacctttggagcagctttgtggggctccatctttggtttcttgctcttgaaggctttgaccaaaatcaccggtggtattttcggccctaaggaaaacactgtctgccagaccgctgccaccgctgccggaggactctctgctggattcatcactgccattcccgccatgtaccgtatgggtcttatgggcgacagacaccctcgggaggatgttgtttcgctgttgctctggtccatctgctctgccttctttggtatgttcttcgctgtccccctcaggactcacttcgtcatcaaccaggacttggtcttccccacccctcgcgctgctgccgagaccatcaagaacttgcacagagccggctccagcgccgtcaaggatgccaaggagtccggtattgtcatgggagcctccttcgtcatttccatggtctggggtaccctcgcccatttcgttcccggtcttttgggcgatctccacattctctactacatgggcaaggccgccggtaacgaggccctcatgaacgctgatgccctctggggctggtacttctcctgggactttgccttcttcggtgctggtttgatgacccctggaagcaccgccttctcgttcgttgccggatccatcgctgctttcggtattgctggacctttgatgactgacgctggctacctctggggcaagggcagtttcactcgccccgatggtgctgatcccgccaccgttgcctctgcccagtcttggttcatctggcccggtattgccatgatggtcttcactgccttctctgagctcggtgccaactggcgctcgctttacttctcactccaggttgtcggtcgtgagggtcgcaacctcatccgcaagattcagaagaaggaggctctcggtgccagcaccaccactgtctccaaggataccacccctgagcatgagctgattcccacctcctggtgggtcagcggtcttctcgtctcgaccctcttcaccatcttggtcatgtacttcagcttcgaggtcccagtgtatgccagtatcggagtcgtcatcctgtccttcttccttgcctttgtcggtcttcagtcgactggtgagactgatatcaaccccactggtgctgtcggcaaggtcactcagttggtcttctctcgcgtccccggtgccgatatcaagattgtccaaaagaccaacttgatgtgcgctaacatcgccgccgctgcttgctcccaggccgtcgacatggtctcggatctcaagactgcccagttgaccaaggcctctccccgcgccatgttgggagcccagatggttggttccgtctttgccattgccattgccatccccttgttcttgctttatgccggtgcctacccctgcattctggtcgagggcacaggcaagacttgccagttccccgtccctgccgtcactgcctgggccaacacctgcaagcttttgaccggaggtggaacgatccccaaggagtccatgatcactaccatcgttttcgctgtccttgccatcctcaacgtcgtcatccgtgtcaagttcgttcctgatgcatggaagccttactggcccaacttgaacgccttcggtctcggtttcgtcaacaccggagtcaacaccccttgctgcatgctcatcggttggtgtgccggtcagttgtggctcaagtttggcagggcctcccacggtcgtctgatgtactctgtgtctgccggtctcatctcgggtatcggtattgctggtgtcatcaaggctgccctgaccatcgccaacgtcgctggcaagaatgtcattgttggttgcggtgaaggtggtgatctctgctaaatattcctattttaccccccacataataaatatccattctaccaaacgaatggcgcgctcagagagacaatttatgtgtctaagtccgtgcacaaagagcgctcatttattcataaagtatgccaataaggtttatcggtaacggatgccgtccagaatgtggttgcgttgatccttgaccaccgattgtagtatgcgtttgaaatactgttgttcatcccggtctgcaatatcgaggatggtctcttgcagcgacatacgcagaggctcataaattggaaagttgggcagtatcgtacagaaagcggtcgcgcctagccaatacacatgcctctctgctatccccttcttggtaaccgccgctgctgcattcgctgttgctactgctgttgctactgctgttgctgatccattcactgctgccgcattcgccatcacttctacaattccacggttgttgttgagaaatccaaaggacgctcgaagaatctcaaaaacagccgcagttaaggagtttggctgcatgtgctccttcgatactgggtccatgcaaagctcctggcaatacgcatggaatctcatagcgcaaaacaaaaagttctggtagatattgaccaaaaccgtaaacaccgagttgaaagccgtatcagtaaaaggtgcttggcaagcgtattgaatcacactatgggatgaaaatgaaaaaataagaatcgtgaagagcagaataataaggccccagcttgcaaatcacttacgtcttcatcctttcggatatggatcgtcctggatgcgaggctctctcgaccgtgagcagatttcggatatctgagtaatgaggatgcagtggtgaatattcagatcaacgactgcgatcacaagctcacgtaagagcgcacaggggctggcacaggaagtgcgcatcttgtcgagtgtcgtaccttcgccatgatagcggctgtaatcaaatctgatctcgagagtctttggatgaagtaaaagaccgcagaatggaaagtctacgacaagcaaaataacgctgtgttacagcagagtatggatcattgcatcatttggcatcttgtaccattccatacatcctcgctgcagtaccatttcctgaacaccgctgaacaacacgaccgttaagagacatgtcaaagttgactatcgtcttgttgtcgttgatgtagcagccgtatgtcggttgccctcgagacatgattttcagaaaagacgctgccttttctcggcttcgactcaaaaacaaaaagtcatctgctagccgtatcaaagcctttagttgggcagcatcagtgatctcaccaaagtacgcgcgtggtgctgaagtcgactacaacgtgaagtatgaacttacactatcgttgctttgagttaggtgtgccaaagtgtccgcctccattgcatcatacagcagtctatcaaacatatcatcttacgggtcaggcagttgggatagggacagccatagcataggatcacacttgaaaaaaatacgaacctgcaaagtgctggcgacaacaccgaaccctgcggaatgccggttgtttgacgataaaatcgattctcaaactttacaatattctcccttatatgctccgtgatttgatttagaataagagatttgcgctgcgacgtatgggcgacctagaaaatgaaagctcgtcattagtaagactgtcatagtttccgccagcatccagcctatcaggcatccagctgtaccttgtctactagtacagcgtgtttggaaatttccgcttggccacgcgcatattccacgaacggagggagtttgtcggaagcaatggcgtttggcgtaaagcgcttgactatccggccctttacaggcgtaactgagcaatgctggtggatggtgtacttttcctaaggcattcggtgtgagtaaacgtgtatcacatccttcagtgcttcgcgactataaaacgagctttcgcacatacttctttcaaaatgctcttcaggatctccagcaacttctcttgattgatggaatcgaacgactttttgatgtcaaccttgaccatgtacactataggtctagagttggatagaggggcggttataaagctgacaagaacgcacttggctatgaaacgtgccttcacgtgtgccccaaatacactaatacgtactgatcggccgcggcggatgtcaagagtttttctttggcttgtttgatgcaactgaaaaggtcattgatcccagatgccgaacggccatgctgagatgactctcgcgccatttcataatcgagaaccagtttcggatttctgagacgccggttgactgagtttatattcgaagatcccattccattcacctaatttttgatgcgaaaacagttgcttgtgagtaaaggatcagcccgcgttgggcagaaggtatttgatcagcgcgcaacttacagttcttggcgacttccgactcaaattagtgatcggacgaaggtcgttctccttgggaagaaatcgaatcgcagcatacggccttgtacataccgtagcctcagcctgagaagaaaaatgtatataaatgggtcagaacagtaaagagagggtcgtgcggacaatttttcactaaagatgttgcatccttaccggctccattttaataagcatgttctccttggtggtttgcatagcatgcttggatattagctgccacaagccatggcgatagtagcagatcttatttcgctggaacgagctgtccgtgatataaaatgctgactgaattcgatcaatgaagcaagcattagcagggatgagaaaaacgctccttctgcctcttccaatatggaaccacaaccattaccttgagcagcggaatcagaaacccctcgaacaaccaatagacgaactcgtgcaaaatctcgagttgttttttcgatgccgtcttaggggtatgagttacgcggctttctttgtactgaagcctactatcttgaagccaggagcaatcgctcagtttgaagccatgcaggacatagtgtagagacagcgactcatacttcctcaagcggatgaaagttgtcatggctaacggtaaagaagacagatggttcaagagaaaggattgagttctgatgtccccccctttcatttctgtgacatgcaagcgacaggcatagctgcggtacctcgcaggatgacattgcggttgtcggtggtgccaagcatgccgagcggaataatatgcttcacgattgcttcaaccaaggacgccacctatatgaagcagataagaaaaaacattgagccttttatccctggatgaatgtagattcattgaaagcgagcgtcgtacctgctcgaaagaactggagctcgccagaagcgcatcgagcgggacaccatcggtcttggagctgtcatcaattgcctagggtcgcatatgctgttgtcagtcaattgccttgtgcttcttgcaacatgaaacaaaaaggcctgaagtgtgagccctaccgccaccggacaatgttgttgtagcaataatttaaacttgcaccggctgttcaaacggagcatgtcgccaaccaaactcttcatccctcgtaatcgccacgtactcttggatttcctcggttcataagctagatcggcacgagttagaacgttgtcgacaccatgctgtttggggaacatgcgccacagttggatttcgacagcgtgcgatgaaagtgtcgagtcgtgcttgaccgtgttgtctacagtgaggatcaactcggggtcaggcagcggtctcacttttcacctcatgttatctcgctggaacattacaaacatacgatgacgacttacattcagccaggagaaattgtcggagcattgtgctctcgttttgatatcctttgaaatatagggccactgtcatcttgaacgatatttcctgtggcgaaagtgttcgatcattgcgttctgttttttgcctcttcttgggtctcgtattgttcgtcgttatcccctctgcctcttgagcgtgctcatcttgaactgacgactctctactgagtggttcagagtgtgcttggtccccaccgtctactgaatgcttcccaacgctctgcttaggtcgatatatcggccagtttgctatgtcttgctcgcttatggcagggcctgtaatctggcagtagcagttgttcggcaacgccacaaacatggatgtgttggtcaggagatagagcatggcttcatcgccaatcctagtgtgttttgtgagaaccagaaagatgtaagtgtctctatgtggcgacactcgagcatgacaacgcgataatcgcgcgtacctttgtaggagtctctcccagggcgcggatcgaacaaaggcctgcagtgtattgggaaaccgattctccgtaagagagttggatgctgtctaatcatttgacggcgatagggtcagagtgggttgtacaaaacgtttgcggagcgcctggtgcacggtatatcagatcatacctgcccctgcccttggcttcctgccacaagaacgttaaactgttcctcataaacactcctcatacggtgatatagctgcttgacggctctcgttacaacctgggatgcgtggaggcagtgatgcagttagtaagtgtggggccttgtgtcgatacgaaggtgcatcagtcgaaagaaagagaacgataccttgtcctggctactgatcgcctcacgcgtgttttcagtaaagagaggggctgtcgtatccgcctctgattcagtagatctaatgtcgggagaggctcgagggtgttcctccatttccagcatagtgtccgcgaccagggtacattgcagaagatctttgaattcagcggggtcgctctcgtaaaccagtgcctgttgcacaccgagctgcacttccacgaattcatccagggtgcataacactgggaacaatgtgcataggacagcattggtaatggctcttactggccgtgacattgtgaatttggcatggccgatgtagggaagagtgggagggccgatgaatggaagagagcaaagacgactatagtgaagtgaaacgaagttttatttttatgagactgagcgttctccgaaacgcgttctcgttggccgctttatagatctccttgactcgaaaataccagcacgcttcacttttttcccacctaaatagagcgccaaaaggtgaaagcgttaatttcaacgttctctaccacgcactcttgcagttcgttgtctctgcgggacgtaccttgaaggcttcagcagggctggtcagattccttttggcaaccgctgtaacatcgtgcggcaaggcgacgatgatggatcgatcctgaccaaacttgaagttatctgccacaacgctgtccgcgtactgcttgatctggtactcgtagtgtccgtttttgacacggcggaaattccaggttatcacataaggtcctgtgctggttacaatcgccttctcctcctcgttcacgccagtgttgaagcgagccgtcgtaaacgatacaccctgcttcatcgatgcaacatgctcgggcctcaattgtaacttgatggcctggggctaagagtgacagaatggcaaggatgaatatgtatcagttagttccatataaaacggttcaactctcagagcaaaggctaaacatgtcatcattaccttttctttagcagggaaactggcatcaaaaccaagcttcttattcgtagggttcagaacatcaatcagaagaaggtaagccttgcacgttgcaatgacccatcttccatttgcggtcacatcaatgccgatgatggggtcaccgagtccaggcaaagctgtcttggcgttcttggtcaggacatttcgcagcttgatgtcaccctttgcgccagcgactgctatagatccgttgtcggtggtggtaatacacgtgaagtcgttgcccttggctgcgtactgcttgaactcgtcgcccacaattttcgcaccagagagacgaggatcgatacggaagagtgcgttgcgcgaatgcccgatcatggttttgttgtcagtcaaatgggaatacttggagtctccaatgatgttcaaaactcccgacgttccaggcaactgccattcctcgacaatctttccatattccagatccatcttgtaggccgtatccaaatctctgggatccatcattaccatcgctgtgtcttgctcgtgtagaacaacctagtttcaagaagcaacggtaggaggatttgttagagtacttttctgcgcatactgcagacctcgagatcacgacacttacacgagatgggttgatttccctgcctttggagttgctaacgttcttgatagtcgttgaaaagtcaagtccatcgtggtcgttatgcttgaacactccaatcttgttgcctctaacaacaaatgaccggtccttgtagccgactgccaactggctgttcatggcggtgtcctgctggaaaccgtcaacctccgcctcgtcttcttcgtcttcgtcgtactcctccttgtcctcgtcttgatcgtagctaccatcttcttcatccgagtagacctcgctctcacgatcgccatcctgtgagccttcccgatcactttctgtcatctccacatcagactgataagttttgatgaggtagtcttggtcatcagactaagtgttaagagctatgttagaacaaaggtcggagattttgaatttacaaggatgcagttgagaaaaaagaagaaaagcctaccgaaactttgccccatgattctctgttgagggcttcatacatgcactctccaaaaatcgactggaactctgaaagagcagcttcggatgggaaacggatcagccatgaaaacacattgctttgatcatcaaagtagttccaaataaacgagcggtgtgcctatgaaaaaaatagagcgcgttagcagagactataggctgctggcacagtgcaaggacgcgtcttgataaacctacagtgctgaacacagcgttcattcgtgattcaagcggctgagcaagcaactcttttccaacggcatcgcgcacaacaagccaatctatcaacataaataagacaatttagtacttttcgcagtgtagcaatgggacagcgctcctcacagtctccttccacatacaagagtaggttccagttcgaagaagctgacagcggaccccatcagcttgactcatgaataaattggtacgggcgtcgaacaagttcagttcgcctacagcttccgcgacgccttcgtatttagaaggggcatgtcgcaccgagggcttgtcgatggtgtgctcgtcttcctgctcctcatgctttacagccaccgttttctccttcttgacagccttcttcgctgtcgatgaaccctcggcaggagggggcgatgacttcgtggcggtggagctttttttttaaagattaagaaatcgtcggagttagtattcatttggtcttggcgtgaggcgcggtaaatatgccacaagctgcttttttttttgcttacagaagctgaaattcctcgatggcctcctcctctgcggaaaagtgcgacttctggtacttgcgctcatacatgcactgatacacagtgatttcaaagttgttggcggtgaagacagtggtttcctcgtcgcagacaaactcgtactcgagcccgcgatcctcctgttacatcacaataaaggcgcggctgtaagtatttggcctgattctcaatagaagtccagcgcgaaaacgacaacggtcttacgttgcttagacctttccaactgaaagtggtggcaccggcgaaaacgcctttcttgaacatgatgtccttatcgatcagaaacaccttctcgtcgtccactaagccatgacagaatggggtatgtgttagtactgcagagcgtccccagtcaacagacgctcttggccaccaagactcatgctcaaaatgaacttacattcctggtcgtcgtcttgcagcgtctcttcgccctcctcaaacactcgattaatggcgagtacatactgaaatggctgagaagtcctgcggacggttgccattgagtcaatgaagctatagtgtagaatgcagacatgtttaggaccagttttcacaagcgcatggacacttttgcggcgcaggggtgccgaagcggcagcttacacgcattctcgagtgcgttgcttcgagcccgttggcttgtaaacataaaactgtccagaggaaatctgcactagctcggggttggatgcatctccccaaattagctttcctaaagatttgaagacgttcattgtgacgggagtgggaggaggagtgaatgaaagcgttgaaagaatgcgttgcggtcggtttttaagctttgaaatgaggtcacatcctctttttttttttctcgtacgtttgggactttgtctttttcctctttcctctttctcgcccacctcgccctccctcgtattcgaactcattcagaactggcatgattctcgagagtccacccttggtcaatgtcactccgctggcagcgattcatgagggtaaagtagccctccttcaccacagaaccgtattcgctgcgcgcgcgcctgagtgacttaccacgttgcaccgctgctctttgtgtttgaatcacctgaatagtgcctattcacatccgccacccaatatatcccaactccactagcaagcgcaagcgcctgggcctgctgatgctgaacgagttgacacgcgtggagatgctagttgcgaggatagaggcagctgggaaggtatatatatgtcatcctgacaggagccggctatcgagcatatagaccctctgaccggtcgttctcaatccaaccctcattctccgaaccagcacgaggaaactagcgcggagctgaaaagatcgattgcacaccttgaacagaccctgtctgcgtacgaactcgagaaaaaacccgcgggcgttgaaaactcgtccggccgcatgctgctgcaagtaaggggatggcctacactgtcacgtttgtcactgactgaccactgaccctgcgtaccaaagagatacatgattaggaccgggctcgacgagatgttctccaagtcttccgaattcctagggatcgagcctgttatacccggcggaaattttatagaaggtgtgtgcgcacctgcggcgtgtgctctcaggtggaccaccacaacactgcaagcaaaagaaatgttaacgatgttgttgagcgttttgcccacacacagctcattttcgccacatgtcgagcatcaaccagctcgtgtcaatcgcgcttcaagttcagaatgacctgcgtctctcgaaccacaagttcatagcgcatcaagttgccttgctctatgtaaagtatcgtatctttgctcctttaaaagacctgccagctgcgtattcactctcattcctgaaatgtaaatgtagcaatgcgtcaatctcgccgggcctcagttttccaagaaatacaagagtcgcatcgaggagaacttcagtcttctcaaggagacagctagtctttccgagacccccttccttccgatcgatctgcaagcttggtgagtgcacattgcttgagtcttatcacccttttttttatcgcgcttggcttgaactgacattgttatgcgtcgttgtaggctgtcgaacctgacgacagatattgtggccgaggcattgtttagcggcagacccatgtcgcagcaaacacctgaagccgctcatctctccaagtatatcgacagagtgtctgggaacgcgccagaggacgacacatgatttgaaacgccgcattttaaatctgtcacaatttgccaccaatgtgagagaaataaaaagcttgttctctcttttcgttcattcatcgactctcctttcttcgtcatgacctcgctacctttgcctttccaaaaggaaatcgtagccgagctcgtttcagaggatgcgcttctaatcctggccaaaggccttggtctgaagaccatcctcggtgcatttctacaaatctactcccagccgcaaaacctcgtcctcctaatcaacgtcactgcagaagaagaagctgtgctcagagacgacctcttgagctcctccagtgtaggaaaaggcggagcttacttccgtaccatcaccagcgagcagagtctcgcggagcgtagtgagctctaccgattcggcggcgtcatgtccatcacatcacgaattttggtcatggaccttctaacgggcaggatccctcttcaccttgtcacgggagtactggttgccaacgctcatcggtacgggatctgctaggaaaacacatgctctctggggatgtgcatcaccggaagactgatggatatctctattatcatgtgtagggtgacggccacatccacagaagcgtttatcctcagactttatcggcaaggaaactctgagggattcgtcaaggccttcagtgaccatccagaagccttctcaatgggattcgcgactctggagaaaaccatgaagttgctttacttgcgcaaagtgaacctatggccaaggtatggacgacgtgcctcatcggttattttggatgtgataaaacacgcgtcgatctaacacgaacattgtgcgttgataggttccatctcaccgtaacagagagtttggagtcgcacactgcagacgtgatagaaatcagacagccgatgacaaaagccatgaaggctatacagtcagcgattatcgactgcatggatgtctgcctgcaggagttgcgtcggtctagctcagcggtatgtttgcttttctgattagaaggtcatatggatgactttgactacagccatagtaatgtgagtaacattcgcctactacgaatagatcgagattgatattgacgactttacagtggaaaaggctctgttcaagtcgttcgatgtcatcatccggaggcagctggatcctatatggcaccgcgtcagcgccaaaacgaagcaactcgtgggcgacttgaagactcttcgcagccttcttggatacctcgtttcctatgacagtgtcaatttcaacttgtatctggagaccatcttggccacccacaatcaaaactcgggtagttactggcttatgacggatcctgcagagaaaatatactcggtcagtgatattatgatgggcgcattgtgacctctcaggagtcgagcgctaatgtagttctttgcttgcacgaacagacggccaagtctcgcgtctttcttcaccaggagggttacaaagatccggatgatccccatatgttgccaaacatgcggccgatcctggaggaactaccaaaatggaatgttttgtcagaaatcatggacgaagtagagttggaaatgtaccatgccccgcatcctgaaggtggttggatacacatacatacaattatgggtttctttttctttggacatagcttgagtgtgatgagctaacgctggtgtttcgcttgtttaggtctggacacggtgctcattatggcgcaggatcaaaggacatgtacacagctaaagagatatcttgcaacaccaaaaaccagtacttcaaccaggggaaaacctttgatgagggatctgatgcatgggtatcttcgttggaaatccaacatgaagcatttcaaggacaatgttaccaagaaaccagggggtttttcaacagtagcagcaaacaatttcagtaatatggccaagaagggcccacctccaagcaagcgacggcgtgtacgaggaggcggcaatatgatggccccagttgccaaacactccacctcgtcgttcgaaaaggaggccgaggtcatagccacgttgtaaggtgtacaacctaccaatggtcatatgagcatcagaccatagtctgtatacttaaggtttcttactgtcacggcttatagtatccatgcgacacaagaggctccgccctcgactgccttggtccatgatcacgagctggaggagattgacgacttcactgattatttcagcttgatcgagcccagcaccttggttgtggttcacagctacacaggcgagtcagattcgaaattactggacagcatcaagccaagattcatcataatgtatgatccggaccctatctttgttcggtgtatcgaactttacaaagcatgtagtcctggcaagcagttgcgtgtgtactttactgtatacgacaactctgtggaagagcagctgtacctcagcgccctacgacgagagaaggatgcttttacaaagctgattcgcgacaaatcggtaagcatgtaatagtgattgattgtgcaacggtcaaggctcggataatgctctaactatggcatgtctcgcgcttcttggaagatgatggtgttgcctataggggacacgcagacaaagcaagtacaggatcaatcgctgcttaggaatatacacacgcgaatcgcaggcggaggcaagtctggagaagacaacccgctgccccggattgttgtcgattcacgagagtttaggagctcgttaccctcgatcctgcatgctcaaggaatgattcttgatccttgcacaatcactgttggtgactatgtcctctcgcccaacatttgtgttgaaaggaagagcatttcggatttgatctcctccttctcatctggtcgactgtaagcttaagatgaatctttatttcggtttgaggcgtagtttggatgtatggtagtaacttttttgttacgcgcttggctcacagatatacccaagtggaggctatgaccgtccactacagtcagccagtgttattgatcgaattcgaccaggacaagtcgttttctctccaggtaatgatggtgctcattacgagggattctgtccatcatagttcttcgacgcctgatatgtcatttattcttgcattttaggacaaatcggagatcaggcctgatatatctgttacagaactttcgtccaagctcgtgctgctgacagccgcctttccgacattgcggttgatctggtcgtcttcagttcatgctaccgtggagatctttgaagatttgaaggtatgacattcttcttcgtatccgccagtatgctcgtctatatgatcttcttcagcagtagctgagcgattgtctctttgccatacagcgctctgaggatgaaccagatgccacgctagcgcaggctgtcggtgttgatccggaacaggagatcgatagtgccttcaatctgacgccacaggacattctccgaagtttgcctggtatcacctccaagaactacaaattggtcatgagcaaagtggagagcatccgggaactggcagagctcgactttgagaacctgaaagccatcataggagagggtcctgcgcagacgctatggaattttttccacaaggactctagactagacatggcctaggtgcaataattcgtcaatttgcaggggttcgcaccttgctcctggccttttacgcttgtatcctcgtcctccgtctcttctctctgtcttcgcatctgcatttcccaacctcagtttctcgacacgactttctttccgcgcaatgtaccctggacaactttacaagactgaatctgggcgactcttccatgcaggagctatcgctataatctttgttgggtaggacagtcggcacacagacacatcacactttgtgcatgcatagccaaacctacaattgatgtcgcactccattcccgtcctgacaaccctcccttttactaaagactcccagcaagaggcaagacgcatgtgtcgcgctctctcagtcgctatctgcattggcttggagtgcaaacgaaagtgttcagcgtgggcaattacagacgtcaaatcattggagttgaggtgaccaatgactttttcagtccaggtacagccggtttcgcttgtgtgcgcccccagtgtccttgctctgacatagcttgaagcgcactgaccctctcacgacctcgttccatccttccgtgcaccctgaacagccaacaaagagacagcaggtctgcggaagcagattgctaacgcgtgtctcgacgatatgatccagtggtttgcgggcggggggcaggtcggtatcctcgacggtagcaacacgacggaggagagacgacaggagctcgtcgagcggttcaagtcagtcaatgtcaactacatgtttatcgagtctatttgcgacaaccctcaaatcatcgacaccaacatccgcagtgtcaaagtgtcatcgccagacgtacgtatcaaatgctgttcttcttgcctctccatctaatggtgactatccggtgcagcatgaattgcagttgtgcatgatcaccccctagtaatgctcaccctccttcttgtcacctggaacgtcgatagtacgtgggatggaaggatacggatgctgtcagcgacttcaaacgcaggatcgaaaatcacataccctattataccactattacagatctcacccaaagttttgtgaagctgatcaacgtcggcgagaagatcattgtcaacaatgtgcaaggatttctgcagagcaagattgtctattatctgatgcatcttcacatctccccgaggaagatctattttgccaaggtaaaatgcggtccatccttcagcatcagcagcgagtcggcgttttcgtgatgtctggatactacactgtgacactgcatgctcaaggactatgtatactctctctatgaatcgccatagaatggtgtctccctcaacgagcattcatatcgcgcggatgctcctttgtctccagcaggtcaccgatatgctgaaaatctcaaaacgttcttgctgactttgcgcgagaaccaggctctcaactcacccgccacctccagtgcagaggccccaagacctttgaccgtttggacgtcgtcacggaagaggagtttccagacagcagcgcactttttggatcacgaggagatcattgtcagacaacgcagcgtcctctgtgagcggaaccctggtgtttgcgatctaatgacgcccgaagagatcgaaaagaagtatccagacgagtgtgagcgagccaagaaggacccttacaggcatcgctttccacgtgctgaggtaatgatcccttattttcggtgttcgcctggagaaaaaaggaacggattcaaagagggacgatctgactgatgatggcgaatgaagtcgtactatgatcttgccaataggttggaaaaggtgatccttgagctggagcgtgagaagaacgacgtcttgatcgtggcgcacgagtcagttatcaagtgcctctatggctatctgtttggtctgtctgagcgcgatataccgtcgcttgagatcccagagggcgtcttactggaactggttccgaccgcgtacacgaccgaggagacgaggcacgtcatccccgactcccttgcaggtgtcaattggcagttgcaagccgctacgttcctgacactcgccggcaaagtgcccgcctcacctgtttttatggatcactatcttcctgacaataagagaaggggtcggcgtgatgatagcagcacaacgtccttttcaaccccttcttcatcgccgtctctctcctccactggtgttgcaagcatgtcgccgagtgacagcaaggcccagcgcgattcatctactgcagatgatctcgagcaagggccagagacctttcggttgtgatgataaacagcggctttagttcatcatccttagaaaaaactgctacgtaattcaaatagaggcgagatgccactctggtccgttcctctgagatagggtatacacaaatagttgaatcactgcatacgccaagcgagaggaattggcgggcatgcccccttctgtgagcttcagagatcagggtgcggatacacgcctcatgtccgttcctcgtttcaaattcatggggtctttttgccctgagcgttgctgacgaagcgggctcaaagggaatttgttccatgaccgaaccatgcggggccacctatgaaggctgggtttacgagtaatgtatatagactatgtgatatatatatgtggtcatatcagacgttaccagcgtacgcctctctcctgcttttttatctttcggcgatcgggtctccaggtaggagttagggcaataacaatggctattgtagtcgtcaggagtcgtcgagaatgaaaaagaaaaaaggacgggggaggtgaagctcgaagccaggagtcttctttttttctcttgctgacaaggagagaacagatgaaatagcaagaggctagctcagaaggtgaccgggttgagaggcacgactggccaaggacacgacccccttgctgctgttctgtcgcctctctgcagagagggtactcggagtgggccagtgtagcgagtgtgcggaagcagcattggcgaggtcgcagtcgccatcccttttatccttgccaccgcgaacgcagtctatcgtctgtgtgtgtctgtctccctgcaattttatgtgtcccctccctacgagatccttgttttccttcttgtttccgtcccttttgcacacatctgcactcactctccggtcgccatccccgcccctcttggttgtcgtgcatgcccgtccgagccagcaaaggcccatccttcgcacccgtacgaccgactgcgcgcacgcgctgaagccgaccgacagccccagccccaaacactgaaaaagatcgttgggcccgcgctcctctgccctcatcgtccccctcccccctttgtcttttctttccttcactctcttcctttctcgctctctccctctctctctctctctctctctctctctctctctctctcacacacacactctctctcgccctctgtcacccttcttttcgtcagcggctcgtcttttcttgcataccaacgactcttgctgctgttctctcttctttttttttctctgttattctagtcgtcttacactctccgtcttcttcctccttctccggctccttcgtctactgtgtgcatcgtcatttggaatcatctttttcacattcaacaactgcattcttgcattccatcccactcagttcttgaccccactcccaccccttacgcctcctcaactgcacctggagactcttcgactgttagcccctgtcccactccaccgacctcctcccctatcctcccggcaatttcctaaagactctttcttacctaaccaactcccgcactgacttcatagacggtgaaccctaaacaacgcgactttgttgtgctaccctaaacaacgcgtcctactgcgcgaaaaaggtactcgtcttggtcatacaacactctacctgccgcgttcgcatagtggactgctctacaccaaccttgtttgcgctgtgtctgcttatgaggatctgaatcatctgtattttcatttccatttgtgcaacgtagaccccaactgtacgaacgcgtcccctcaacggttctcgatgcgcgtgtagtcaaccaacagcttcctcctgcccttctctcgtcgtcgccagtcaatcatcgccaaatcccgccacctatcaaatgtcaaggatgctcgcgcatggccaaccaactcgtcgatcaacaccagcagcaccagcagcaccagcactctccaggtcaacagcccactttcatgtgcatgcagcaccctcgcctcgccgtctcgttcggttctcattaagaacatcacctgcatgctgctcttccatgatgctgctcgcactcctgctctcgttcgcccccttcatggcagacgctagtgtggtagccacagcaacacctccaaaagtcccgatgtcgtttctccactccatgaccccaccacccgtcgatctttcaatattaggacagatggcagtcttgggagactttgacgcaataaccccagtgatgacacccggacagcaaaacaccttcgaaagcagcactttttctatcctcgaactctcaaaggtcgccactggatctgcagcaagcgaaactgatcaccagaaaatcttatcggtacctgtgctcttggccagcttcggtattgacgccgacgagagcggacgggcaccggcctatggcattagcgccacatgtgtactggagagcgccccacaccagatctacatcggaggttacttcaggcagacaccctctagctggaaattcgcggcaaatcagagcaatggcaccctcgcacccgacaaagctagccccacctcgacaagcaacagtgtcaggacggggctcaactatgtaggcctttacgactctaagctgaagcggtttttggctatggagaatgggctggatggaccagtcgaaaacctcatgtgcgactctagcacggatcaggtgtttgttgttggacaattcagagcaccgttgcaagacgaaactcgctccgacagcagcagaacgggtggtggcagcagtgacagatatcaagcactcggatcctttggtggaggtgttgcggtgtggaaacgagcgcttggcacagagagtggagcaggaggatcgaatggaaagtccagctataacagccaactccaccctcctacacaagcatcaggatcatgggtgccactgcccttcaaaggagtgaacaagattgtcacgtcggtggctaagactcaagatggcacgtattactttggaggacagttcgacaccactaccgacggagaagcgttcagcgccccagacactcaacttgtcaacttggcatccgcacaggtatgtaaaaccgatcatgcgacttgcattaacaaaaaaaagggggggggggggaaagggggaagactcaaactaccaaacgactgcacaggaaaacatgtctaatactcgtttttgctatgcgcggtccatatgacctgtaggtcaattcagggaacggacttgacgtggcacaggataggagcatcatttgccagaacggtactagtcctcgcaccaactggatcatgcgcgacaacatgcctggatactggcgcgtgaaatttcctcttctcatcaccccgacactcttccgcctatggaatgtggacgtgacccagggttcagaatcagcgaaccgcggcacaaagactttctcgatcatggctcagccctcaaaccaatatcttaacctgagctatgttgatccaatctcgcacactctacaatactgcactgtctgtcctctcctcccgagactatcgtcgtcctcagaatcgctgcctgctcaaagtggataccaggacttcctagttgtcaagcccgagcttctgcgtgctgcgcagatcgacgtcgtctcatggtatgggctcggtggtggacttggaggcgtcgaggtataccagtccgagatttttgttcgggcggtggacagcctgaattttgctgccaagtgtgcatcatcggaagcggcaacaagcgcggagggcactcacgagaaccgggacctaaccgcatattcgagcttcatgggtgccgactgggtgcagatgagaatgcctgacggctggcagactgttcttgcggcgagtgtttctgcatcggatgaaacagctcgcaagcaagcgtatgtggacatggcgccttatctgcaggagcaagggatgtacgacgtctttttctatacgccagcctgtggttcagccaaagacgcgtcgagttctccgtcaacgccttccaacgcatgcgcaaaccgaggatccgttgacgtcaacatgtactttggctcacctcagaacgtggtgactgtgaccctgcagcagaccaataccgctgacaagtacgagaagatttattccgggatgattgtgcgctctacacccgactttcggccacacgtcgtcgtgaagccttccgatatgaaagcaggagccagtggcggtggcgcaacgcagacagtcatcgtggattcgatccagtttgtgaagcaagcgactctgaacaacacgaacagcttgctcttttaccgacctggtccagggcagagtctagcaggaggagacagaagcaaatcaggaaagaatatggtcgagggtatcgactcgtccacatggggcaaccttgcgacacagcttccaggtggagcttcagtgaacgcgctcatagcctactctggatcttttggaacgtcaacctcggcgtcatccacatcaatgcttgtcgttgctggaagttttcaaagctcgggatactccaacattgtggcatggaatagtggaaagtacgttcaacttggtcagccaggcagttcctcatcaggtctcgatggaacggtcgcagatatggtccttgagcaatcaacactctacatggttggtaactttcaacaggcatacggtggcgctggggataaaggggttccccctttggcaggacttgcctcgtacagcatcccgagtatgacatggacctccttcggaaatgtgtctcagaatttccagccaggtgcacgcttcaagtccattgagctctcgactggtccagccggtcagccccaattgctcattggaggcgttttcacatggatcgacgggacgaaaagcgcatcactggctatttgggacattgccgcccaaacctgggtcagggaggacccggaggcgtctggaaacggtaccacatcgagcagcaacggattcgcctttgggtttatgcgaggacagatctcgtatctaagtcgcgtgctggcatccagcagcgatggatcgacaacaaacaagactcctgtggtcctagtcgctggaatgatacagtctgtggacacctaccaccttcagcaaccagagagcatggcgtggctcacggaatctggaaaactgagcacatggaatttatcgcctgctatatctgtttcctctggaaatgccagcacgatcctgaagtcaggaagtgcggagcaacccaaaactctggaaaaaacgaacgctggagtgctttacatgaaccctggctctcaggaatgggttacagttgtcggaggtgctctagcagacggcacgatcggcatcgggttccttcgtccatcacaggagcgtcctggtgccttcgtctacaaaaatttgaacgttgctgctgctacttcatcttcaatcaccggcgaggtcttggcactggggattgacaaggatgagaccaatggccacaactctttgaacgcagggagtgatctgcttttgatcggaggggcttttaaaagtcctgggggcagtggtgcttcagaagtgaatggagtggcgttgtttgatctcacagcggacgcggtagtgtcggcgacccttatgccggctatacgcggcgtttcaggagtgggaggccgggatcctgtagtgcgagtgatcaaaaggcggccaggatccaacacgggaactctggtccttgctggagacttttcaggcgtgggcactggagtgacctgcgagctgatctgtctttgggatccagcagaggcccgcaaggcactggacaagaagaagccgttggagtcgagcttcaagtcagtctatggcgacaatggcagcaacaagaaacacctcgggatcatgcgaggagtcgtgaacgacattgcctttgaggatgtaatgtttccatttgttctcgcagtgtcatcctgtcgagggctggccgtcagagctgttgtcacagtttcgctttcgactaacagcatgtctttgataacttctcaataggattcgaacatgttcgtcgcaggagacttggttgtgaatggagttccatgtggcgctgccagcttcaactttgacagtggaagatggactacatttggatctataacaattgcaagcaaaggaaccgcggcacgacccccaggcttcgacgtgctcccaggtcccgcgacggctatagctcatgactctaatctccaccagttctttgttgctggacggtaagaaagcctgccgcgatgtgcaagatatttagtgttgtctgttctactgagcctctaacgcttcgtgcacttgtatcgttagaagctctgtcgatggatccgcttacttcaaaaaatggactggaaccagattcatccgcgtctgtatgtgcacccgcagtggagcaattgaagcatgggctgttgccaggtatcatgccctccgctaacctttaaagtatccgcatcttcaattgtaactagcgagcgagttcatgccgactagcgagatctatagactggagatccttccagcctctaaggatgcaccggttaggacatcaggatccgcatcaacctccagttatgactctaacgacaacacgatcactaccaataatgacatctcaacgagcagtaccgacaatgagaacaatagcagcgaaagcgcgccctctttctcgcctggggatcatagttccgatacaaccgacattgttgagcaagggttcattctccttgtctctggccgtatcgtcctgggcgattcttcttcaacctctgccatgtctctcaacaacgaccgccaagagtcctcgcttgcattttttgatggccaatcatggtttccttacctgcaaagctctcgtaatggaagctccccctcgttggatggtttggggtctggcggccccgctgtcggacctgccacacctgtgagcgccatcatcaaggctgaaaacgtgctgaaagcacgaagcatcctgcccgacctcagcatccttgagagagctgacccagcttcagcagtgctgacaacgttgccgattcgtgttcgtgatcagggtgtgttccgagccctggccatcgctcatctgccgagaatcatagcacgtgaatatctctcgctgctgcaggttgttcttgtctcgatggcgatctcgcttggcttgattgccctgattgtgttgcttggattcctctttatgtatttgaagaagcgcctatcgggagaggaggaacaacgacaacgcccacgtctggcaacgtcttatatggagagcggcgacggacctcagagacggaatggtggcagcggtggtctctattttacagactcttccctaggtgtgaaccagagccctgcatttggcgtgggggcctcacccgaggataataagaaggctggcagatactttttcagaaaatggtccagaggcggaagaaaggaacctgacagcactgaagctctcatggcctctctgggtatcaccagcgcgctagaggtggcggcatcaaggcgcggtggccatctccgacgtggaggagacagcggtgctggcagtcaaatatttcatccgtctcggccgcacgtctaccggcccaattcgacgattgaggaggctaccggtgcacttgtcacagagtttgtacggagtcaccagcagcaactcacaggtggctcacagcacgcgctggatcggcaatcaagcgacgagggtcctcaagctcctccatcacccgaccgtcggagcaaaaagtcacggctctcttatccgtacaatcgtaagttcattcgtcgcgtcgcgtctattttaaggctccacgctcacacaccatctagatctctaacgacgcgtactttctttcttctttcttctttctttgcactgcggggcacttttgttagctgcagtagcgcaagggcgagattcaagcagtagtgatctcatgaaccccattacgcaaggtcgattcgcttccctcctggcagccgctgatgcccaagatcctgcaacaccacagtcccaagcgcccacgtctcctgccacgaccatgactactcctggaggcgccattggcaacaatcttgcagacctcagttcccaaggcaatggcggcgtggtttattatgcgaaatacccattccgagcacgagaaattggtgaactcgggttcaaggctggggagcggatcttggtcgtggatatgagcgacgatatctggtggatgggtgtcattcagaattccaatggacagcaggtgcatggcgtgtttccttccaactacgtgggctccacaccataaggacgcgcgcacttttcttttcttcttttatcttataaactaattcttgacctttcgcctgtcaacaaaaggcacactttgataagcaaaaaaaaaaaaaaaaaaaaaaaaaaaagggccattgcgtgatccgtgaacgctatcgctatgcagtactatgactgcgcttggagacgtgcaagaggttcgggtcaacattggtcatgcaagtggattatcttttaggcaactggggaaggatggcctgacgtttgcgcatatattgatgcaaacatttatgcgttcccacactccctcacagagtgaggcagaaaaaggggggttgtcaaatagaagaccaggcactagacgtgcgcacagcatttgatacaaactctacactgaagatttgatgtagacgctaagcgcgtcatgtaagaagccaaaaaaaggtctaagcgctgatgttgtggaaagtgggatccctatgcagatcatgcaagaagcagagcgaggtctaagcgctgtttttttatgtgtataaaggaaaccccaatactatattacctttttggtcaagctgctgtattcgggctagtatgcagtgttctcgatggacgccagagcgcgctatccactgaggcagacgcgcgtactgtgaagtacattggacgcttttcgctttatgcaaactcactgaaaaaaaaacgaaggtagaaatgtaactccatggcaatgtgggcagaggtagactgttgatccgactccattacagcagcggaaagtggcggtcggtcctgcgaaataggggtaggttgtatgcgaggctcgcgtttagaactacaggacgggaagcgggatgggaagacaagtcgagtcattggtgctgcctctcgtataaaaatgcagtctatccctcattcatctccttgtcttcacacctcatacgctccctctttttctcctcagcaaaccaacttccatactctcaaaaatttcaactcgcgtaaagctaatgtaagcccagtgagactttgattgcgtccatacaataatatatgcgaacatatttacctgatgtttccttttacgcctctagtatgaagtctatctcaatcgcgcttctagggttgttctagggttgttggcatctgttgcctacggagccgcatgcaagtccgaccccagtaactgcgcaaatggtggcacttataatcctgggccatgcattgacaagcgatatagatttccagactactttctctgcacgcccgagagtgagccacgctctcagggtctcgactagaggcactaggccgagagctgcggcggtcctcagcgccttcagcgcgactgctactggccaggtgaggagtgcagcaagcactgggattgttgcaaagaatcatgcaccaacggccgatgcgacgaataagccattgtcaactgtattttttttcggttcattacctgaaggtcaagacgcaaggccgaggagaagccctcgaccatgatcgctcttgtgtgatgaaacatgacaggcagaccttcaaaataaaatctttcttgccatcgatcgaggttacattatcgcgcgatgtctagctcatgtgagatttcttccggagttttcttcggatattcctctgcgagcaccaaatgaagggaatattcaacaacgtgagatgcatatatattgttcattcatttcgtagatttatcgtagatttattgtagatttattgaaggacagaaacaaatatggtacagaaggaaacaacggaatgagcggatcaaatggaagcagtaaaagaacaaagaacacgcggaagatagaaacacaacgacagatactagagcaacatgatttcataaatgagatgcataaacaacaattgggctgacagtgcgaggacaatgcgagaaacggggagaaagaaaaagaatataaaaaagataaaacaggtgctgcaaaagaactctttcttgtggcacaaaagttctttttttttacatgcgggaatatccggcagtgcggaagccgagctcaggctgcttcttgtccagtgaaatgtccttccaagtcacagtcttgttgtagccatcatgaaactgaatcttgcagttgagtttgctgtgagtaacactttcgacgactcccgagtagtacatattgtcattccatcgggcccatacagagaggccgggcttcagtttcttggccatcatgtccttccatgcattatattctgtctccttttcctttgactgtcgctgatgggagaaaaaagagataagaaagaaacggttagaaggtgttcaacccagtccaaacagaaacaaacccctgcaatacagcaatgccttacaggatcgtgagtgggacagtacacatggtactcgatgctttccgtttcctcctgcgcgacttcatccacatgcattcccgccttgtcagcgcagctggcgtgcatcgcacgaatgcactttcctctacagcattggatacaggctccaacctttttctcgcaaataaaacagcgctatgaaataccagataaatccaggttaataaagtcgcgcggagcaaataagatttttcagaacgcgtgtgccaaaaaaaaacccccctccttaccaattttctcctcgctgcaggcacgccctccacatggactataacgtcatcgtcctcttctccagacatatatgtctccgggatgtactgagcgcaaagcatatggcagtattttccattgtcggtggggagtaattcgccttcatagtccaaaagtggacagaagcagcactatttaggacaatatttttggtgaatttccattgtccaggggttatccaataacagcagagaacataaccgctcgggcacgtacctctagcggtgtctctgcctttgttttcttgctggaggccgcagtgccttttgatgacttgtcgacagtcgctctactgggtctgctcgatttgttagaagtctgatccgtctccatctgaaggtccgtatcaacagcctcttccttgctggatcgctttcgtttcctgggcgtatcgtctggtgtctgctgcgtcacctcttccttcatttccatatctgtcgacttcttgctggaccggttcttggaaggtgacgtctccattgcaccttccgcgagcgccgcattgtttttggatgattgaaagatagcctcaacgtctatctgaacactgtcattgatgcacttgcaagattccgctttgcgtccgatggggatccagtcgctgagtgcaaagttgatcgattctgcgcagttgaagcccaagttgtatccagaatggtacgcgaacgggaatgtgaggacaaactcgccctcatgctggaccagccggttaacagggacaccatccgtggccagctttgtgggcgaaagcagatatgtcttgtggcgtaaaaactgaggacaatttttgtagtcggacgaaaatattccctgcgcaatgcactcgaaacgactactgtgttctggtcggatgcagtaccactgcttgggtgctccgaaatgcaggtagttgatcgaatatagatccatgtcctcaacgtgccatgcaaaggttgccttccacattccgaaataaaggtagggcgtgttgactccaggaaggttctgatcaatctttgatagcaaatctcccaagcactgagtgttccatgaagttgtcctttcgtcaaacaatgaccctaaaatatggtaccaaaatcataaatagcaatgacgacagtgagtgagccacactaaaacaaaccctaacggttctgcccgatgtgatggatcatcctgctgcacaaggagtccatagatgccatccccagtgttcctccagctagtgcaatgaaactgcagcgagggtccggcacttgtttctcgccgttgcattgcatgtctctgaaatagctgggtttttttctgatccatgactcctgatgctgccatatccatgagagctggcgtgacctcaagccgtgacttaccagacatgtcagccccgtacatcggctggacgaacgtgaggttgcgccagtaattccgctcgacttccttgcagtattccacagtatagtcttccccatgttcgaccttgtagtccgtcatgggtggctcaattttttcttgctccactgccttggcttccttctgcttaatgctgttgctgttgctattgctattgctgttggtagctgcgggtgcgactgcaacatcgtcctttgtctctggaacaaacgatgagagcgagtcctgaacagttgggcgtcgtgaggttggagtgggactggaagccctgcgaagaaaatgcctgcgggccaaattatcaggtccaagagtcgcttgagaaggttgatcgggactatgattcacagaggcaggggcactggatgggacgagggcatcgggcgagtcctgtaccatgaagtgctcagccgtgtccggatgatgtgttggcgtggtcgggatagagtcggtctccatgggcacggtcactggctgtgcagagcccgccagcttgcgatttctcttgcgtcgtgggagcgggtcggcaggtccatgcggggctccctttcgactgggtggacggtggtcggaatcctgcgagaggaccttgaactctgcgacagagtaggattttctggactcgatgttagtctgggtgtacgtgcccttggtgccccgaatgtgttggataataggagtcttgattcgcacagacgccaggcgctcagaaagatctggaagggcagcggtccttgatagcagaaagcggacaagaaagtgaggagacaagagaagtgtgagtcgaggacgtctttttttttttttttttttttttttttttttgctgtgcaccaagtgttaggtgttgcttaccactctttgggaggaatgatcttgaccagacccgcctcacgcccgtagctgacaatggactctacaaacgttggaaagtccttgaactgctccatagtggggcggaagacggggatgccaccggcaacattgtcgtagtagtggtcaggttgaatgtcgattagggtcataatgcacaaatagctgctgagcagtggtgtgcaagggagcgttgcttgcaggagcggcgagttggaaatggacaagggtgtctagagaaacgctagagagacaaggcgcagaattagtccatgaacagacaagaggacgggcggaaaagtgagcgaatatgtaagtgtgcaagatagatagagagtgagtgtgtgagagaaagagaaagagagagagagagagagcgaaaagggacgggaacgaggagataatggtatgatgcgtatgtgcgaatgtgtgcttttttgtgtgggagaaagagagagtgagtaagaaaagaaagacagagagagagagagtggagtggccaaaggaagaacaaaaggccaagcggaaggggggctgcggggctgcacacaatccacaggcaggcccaaatgtgggtggaagcgagcccaagtgcgcgagggtgcacctgacaaagctgggccagaactgcctggttagtgggcagcgcagacactggcaaaggcactgggcgaggcacttggcgaggcaagggggcgtgctgggtgtgggcgttgcttaggcgggtgtcgcggcatgaaaaggagaggaggctgtctgcggcagagaagggacgaaggggagtgtgcagccagtgcagccaggctcagaatggaagggcgagagaaggcaacgagggaggaggcaatatcgcctggaggcagcgacggcaagaggacacactttgcaccgcaccgcaccgcaccagggctatgcgtgtgcattgacacacagctgacggggagtggggcatcgcaccgcacgagcgcagagatgctgaagcaacgggaacacaaagactaatacgagagaggcacactcgcgtgcgcacaatgaccgcatcatgtccacggagaaggcatgcgttgccgaagacccataaaccctaccttgagtgtgctgcagatgggcgaatgcgggacggcagaagggccaatgaggtcgaagaaggtcaaagaggtcaggctcggggggctgcgggtcgttacgcagggctgattcgagcgtgcgctggaggaggcagtcgtgcgtcagaggagtcagaggcgtcggacaacgagtcggatgcaagagcggatgcaaggatgcgccaggggggtcggtggatgtgcgaaggactgggtgcgaaggactgggtggggcacgattaggatcagcgggacatgcaagggtgcgagggcagcaggaggaaatggcgagtgacgaagaggaaaggagggcgatggcgaatgcactggacgaggaaagtggacccaccaaatacaaaaataaaaaaaaaaaaatgaaaaatgagacaccgaagaagaaaaaaaaaattggagggagttttttttttgttgttgtttttgtttgtcgtttgtcgctcttgcacacttcgctgtcttgaagctctggctgtcagcccgcatttcttttttcctttatggctctggcctacggatgcgccagatatggctacgcccagcaactccagaagaagctgtctcgctctgcattcccttttacccttttggtgcgcaacacgcatgtcgtgctggtctggatcgtggacactccgccagcccatggcgccatctgggtcttgcggctgtgctgtgctgcgatggccccagcgactcggctacccgtcgcttggtgtcccgtcgcttctctgtgcgtaagtccagggtctcgattgctttcgaactcagttgtcgccatgtgggccattccgtggtcgatcatgtgatcgcgtcctgcacacgcttggcacacagatccgtctcaacgaggacgatcgttgcggccaggtgcctggtgctgggctggaggtagttctgcgtggtaaacgtagtttggattcatgtatccttaagagaaaaataaaagaaaaagaagctagtgcccgtgagtgagcactctaatattccaattattagctggtcgcacaggtgccttctccgcttcttgctcgttggcgtgccaacgaaatctcgtaacacctataaacacagacgcgaacgtttctgcagtatgcgaatgcgacaactcccgccgaccgttggtatctcatgcgttcaatggctgtcccaatgacgggatccacaggtgcccaagtaatcccttgctgcagatctctcaagccacacgccatcttgcttccattgtctaaagatgagctgcaggcgagcagagtacactttgcagcggtaactacagatgatgcatggctctgcactaacaagagtggcgaggggaacattcctggcgcagaagtgcagacgttgtttaccctgagccaatgcatcgagagcagagtgccgtgatgcaggaggatgtgtacaatagtatgtgcgatgggtaccccccttgtgcatgcttatgcacgtctatatttcctgaagagacaccgacagggcgcgtgcaaccttgctggctgcaatttggcgatagggttccattcatctcacaaggttcaaattcagtacacccttgcagctggccgagagtgcgtttcttcatctcgaacaccctttccgagaaagcgcattgctcatggccgtcatctctctcgtctccatcgccttcatcctctctctctctcacactctctcttgactccattcatcgccctcccattcttccttctcccttctcccttctcgcttctcccttctcccttctcgcttctcccttctcccttctcgcttctcccttctcccttctcgcttctcccttctccgttccttcggtccatccattgctccccccactcctcctcctccttcctccgccccttcttctcgacctcccactcctccttctgaatgccctgctcgtcaagaaggagctaaacacggagtgtatgacacttgcccctacctcgctagtcaccgctcacacacaacggcccttttgtacctgcccctttatcgcacactagccgattcccgccaatttctcaatggcctcggtcatccctcaaccactgccaccgtcgtacaccctcgaagcaggacaggaggcgtacgtgccacaatacaatcgcagtcagagagaggatcgtcccctgtccccggaatggcatcaccaccatcagcgacaagaccaccaacaacatccgtaccacctgccatcgcatcctcctccacctcctcaaaccttgcacgaccagtcacatctctacgccctccctcgccgcaactctcaggaacgatccagcagggatcccactctccgttcaaagaccgtgaagcgcgtcagtaaaacctttccatccgatccattaatgaagcaacgaaagaggtcctccaagaataatacgcatatggtaagtacatggaaacttttacgagcgacaacctacaatacagtagtacagtccgcttgggaggttccacaatttacgcgtgaaacatagttttggtacattattttctactctggcgcacagaaaaaagaaaatgaatggagccaagaaaagagggagaggagaaactgctgtggaggagagggcgtcaagaccagactggtgaagacagggtgaagacagggtgaagaccggggaattgtaaccgacacagaaaaagaaaaaaaaaaaaaaaaaaaaaaaaagcagaaaaaatcagatgaagcgatctatgtatcacgcgaaacttgagtcctggtcggacgaagtaggcgagatttggttttttttaggcacgttgtgacatgccgatagcacacgacagatgccagcgccatcagcaccctagctgctgcaactgtttgacaggtgcttccccttccttcccctcaataatacatgcgacagagagagaaggaaaaagagattgtttgcaatcattgctctttcataccccctggagactggaaacaagtcaaaccaagctcacgaggacgtgcaaaaaaaaaaaaaaaaaaaaaaaaaaaaaaaaaggacaaaggaaaaggaaccactatgatcggagatggtagcgttcgagacacaagtggtgaaccagagggtgtctgtggttcgagtgacatgttctgcccaggaacgggtgtgtctgacgagagggttacctcttgagcaaagactacggagagcttttgctcatgacagtggtccgacgagagggggggggaagagcgaccgttccagcgcaacagacaacgtctgtccagtgtcctccagcatgctctatttctggcatcgtcatctgctcatgcaagccatttgtgtgtggtgtatttgcagttgccagatcctggcagaaatgggtctggagggcttgcaatcaagagcgatgtgtgttgcaccaatccttatctggctgctgatgttgatgtgtttgttgtgatcattgttgttgttgttgtcggaaacgaggaggggaggtcaagtttgcggttacgccgcacaaaggctttgtgggagcatccacaccgtgtgcgagtcgtgtgggtagctattggtgggaagagcaggtacttggaaagaaaggccgcggcagggcctttaatttcatttcgactgcaggggcgaacaaatacattcaagcattgcacgcaggtacctcgcgctggatacgccattaattcacgtcgcacacccgtaccactcgcgcatcagcgatgcgtgcgggggtgtcttccatcgggcacactgcagagacaccagacaggcaacgactctttcctccttacctcctctgccctctccccctgccgctattcatctctgttgctgctgtccatcccatcgacgtatgcaccagacagacagctagctacgcccatagcgacacacacagacacatccctgctcacgtccgtcgtcgtcatcctcaactattaacacagctgctccctcctcacccttcactttcctcgctcagcatcagcataaacgagaacccgatagcgctacacactttcaaaaggatccatccctcccgcccgcaccgtcgtctgcaccccctattcacccaactcagcagcagggctcggcaggccaggatcaaacccagcaggaagactttgtcccctacatacccccagcgataaagaagggtcttgtcatcgatcggccctacagctactacaaagtcgcaccgaaggagccacagcgggtcacacgcatcgacaaccctttcggaccacccgagccagtgtccggacctcctttgccccttggaaatcttggcaacagtggttcaaactattatacccacccctcacaacggaacccctttgaggcccccattcagttccagccctttcgccgcccctcgcagcaacaacaaccgcaacaacaacagccgctgcaccagacatcagcacgtagggagctcatcaaaaaagagcgacctgatcctgaggattctatcccagtcgagcctgtttcctcctctgcgccagcagcgaccatgatggccagtgtcatgtcagagtccttacctgtgcaacagcaccaccatcactctcaccacacacgcgagcgatccaattcagatcgatatcaaagatcagtctctcctcgggaggacaaaggcacgacaggcatgaaccgaagaccttcagatcccgtaagcatttggatttttttttttttggtgtgctgatttcatcagctcgcaatttttttggtgttccagtagatcatcccactgacttcccagtttcccttttgttcactcagaatcatctagtacgcagccatagcagcggcagcggcagcgtgctccagagtagacaacaataccagcaagaacagcaccggcgtcagctagagcagcagagccaggcactggaggacaagcacgtccccacgcgcaagggttctggcaacaacctcttgcgtctagcgcgcaaggcgtccgactcggctctgaaaagcgttggcttgagcaggaagagttcagacaaggcctccaaggccgcccaggccaaggatggtgccgtcgccgggcagtcgtatgctcagaatgtacagaactggggaccgcaaagtcgatcccaaccgtcactacagcatccagactcggctcgtcaaggtacttgagccttcatggcgctcacattgctccttccaagaacagcaacaaaaaccgaaaatggcccaggcgtctaacgcgttccatcttttttcctctctcggcggtttaggcgacgatcaagtgcacaccttccctaggacattcgaggccgaactagggcgtaaaaagtcccttccagaccaccggacaccgagcagagggagctcgctcaccagaggaagttcacttagcaggcaaaaatccaaccctggaccacttctccatcgacagaaatcacagccacaaattgcaacggccatgtcacaggaacccatcaccgccgtagcggcagagtcctcaggtgcggccgtacaggacgcctatggtggcacgacagacgactggcgacaggcgcagcaggcggagaaagaagccagagagaggcagaaactgaaggactcgagccccactgaccggacaggccacatgtccatcaactcggtcagcaccttgaacctgcctcccaccaatccttttgccaccaacacccacacatctggatcgaccagcaggatgctgctgccggatagagacagggctgcagctcatagctcgagccgcgcaggacatgcagcgagtgggcaccaggactttgcatcggagccgactcaggagagcacctctctggccaaggcggccatgcagcctggcgggatcctctctcaactgcaggcggccacagacgcaggaacggtggttgatccgaccatgggcgtctggtcccaaaaggagggtcggtacatccagaggtccaacacggcgccttatctgcaacgtgaaaacaggaccattgtcgaggaagatgaagtggaccgtgacgcacctggaggttcaaaaggaccattggaatacagcaagagtgaaggctattctgccaccgctcggcacaatcgtcagccgaagcgtgcacaggcccaacatcagacacagcatgagcatcaggaagggcacgacggtgtgcaccagaaggagtctgaggaagggcgtcgtacctacaatgggtcacatccaattgccacaagttaccaggttcatcaccagccccaccaagcattccaggatcaacctcctcatcacctagagagccaggcacagcagcaactgcaccatcagcagcagcgtagccacactctggcacgggcacgcactaaatccaacgaacgccttgtggacaaagagctgcccccaacaccgaaccctatgcctccagcagcgacactcgatcatgatcctgtccatgagtcccagcaggtaggcgaacacccgtcccaaaggagaacgcaccagcgcacagagtcccgatcccaggctcagagacagccccgttctagaagcgagagccagcccgagtcctcgaaacatcgccgtcagccgtccacttgggccagtggagtcgccctgacctcagaagagagcgtcctggcgctgtctcggtccatctcgccgtcgtccaacatgcgcatctctcatgagcggacaggcagtgcaggacatctcccgcgattcggtggtggtggtggagtcaatggcagcggcactctattgtctcacagcagctctgcgagtggacaaaaggagcgtgtacgctatggtattgacatgcttcccctgccagtgatcccttctcctgacgaaacactcaagaagagcgcaaacttaggcatcctcccacaggatgttctgagaaccctggacccggaaacgattcaaaaggtcatcaccacgtcggtgattgccagtcgtgtctacaaagtgctgagctttgaggaggttgagagtctcaagaaggagcaggaggatctgcagcagtatgtccacgccctcgatgtctctctgaccatcgagacccgcatgcgcgacgcctcacattcgctgatacgcctgcacgagaataacaccaacatcgaggccgtcaaggcttcaacaggacagctgcacgcaaccactcgcaagatggaccagattgtcttgaagagaaatcattccatggagcgactcttggtgattcaacgcatgttgctgcagcacgagggggctgtcctgaacgctggcatgcgacgactggatggcgagaatcgagaactgtcaagatccgtcctcgagctagaaacggcccgaaaccaggagaaggaagagaagctaaagtggaagaaggagcattcacatctccggatccagagcatggtgttccccaaccccccgggtctcgatggacttgcagcaatagcagcgggtggcagtcaaggctctggaggcggtcgggactctcccgcccgcggacgaaaatctccctctggtcgcaaatccccatctgcagcgcaacaacagcagcagcagcagcagcagcctcgcgcaccttcaccgccagccctccagcagcagcagcatgacgcacggctggctgctctcgaaaagtacatgaaggaactgcacgatgagatccacaagaaggacgagcgcatcaccgagctcgagagccagctccgtatggtgaaggtctggaccgacgaatttcttggatctgtcgaagctaagcttggagccgataactctgtagtggaccaaacccagaacgcgtcctcaacgggtcttcacaaacaactgacacttttgcagtcaaggatcgagaatgggttccgcgccttggaggccaacgctcatgagctcaggatcaaggcgcaggaagaggagatggccaagaacaaggccctcgagtttgcagcgaccacccttgccaacagcagcgcggccgtcgttcaggccgtcacaccccagcgcgcctcgccgcagccgtaccagggtcctcaccatcgtcagcagcaaccgtcgcccaccagcggttcgcgagcccgtaatccattcagccgctcaaagactcctctgaatgagcacccctctcaccacggcagcaacaacaacaacaacaacaactcggatcttaacatggtcctgaacgaaagtcttctggagctggatctccaaatctcgcttgaccatcaaaaccagagctcctcatccccttcctcgtcctcctcggcgtccaccccagattccaactcacacggccgcttgagcaggaacaacagcgagaaccattggtccaaacagcgacacgagctgaaccagcgcacctcgcgttcccggcagcgtcaagtcgatgcccaggaatcgctcgatcaatctcatcagcaccagcaccagcccaaggacgagctcctggtcggggacgcgcacgaagagatcaagcgcctgaacgccatggtcgatgaactggagcgacttgtccgactcaagatgcaatgatcgcctggaaccatccaaccccctcccccccccttctctctctctctctctctctctctctctctcccccccttttatctatctccctaccggctataaattagatatccacctatcccctaatgcctacgcacagacacgttatgaatacaccgcaacagaaatatgtaaaagaaaaaatgaagcttgatttttttggctggtcttttgcttttctttcgtcccatcgtccttcctcgcaatcgtcgcttacatatacatgccgtctgtcgccaccgcctccacgatcctcagctccgattcgcggaaacacgcatacaaacgacgctggagaggccgcgcatcccagacggtggtctttgtggctgggagtgttgccatagagccttcattctccatagagaaggaggggtcgtacgcctcgaggatgaactcgcgggacgttggctgaggaaaggaagattgaatcgaacctaaattcaatacagaaaaaaagcaagcggtaattgagtatgcgacctgattttttgtccacacaacaaaagcatgcatgcctcacaaacccagaaacgacggcgaggtcttcctagggtaatttttttttcgttaccaccgatcgaaaatagatcgtaaacgcattctcgctcaggaccatcctctacagtcgcctcatggtcctccagtatcctctcaacaagaccatactgctctgggaactaacatggagacatggaaggaaaactacttagccaagtgcacaagggtcatcacaccgcatctcatatccgatttctgaattatggcaataaaaaaaacgttaccttgcggatgagggcaatcgcccgtcccatgagcagctccacctctctaaacttgtccacaatgacgtccaggttcagctcttcgtcactcgagagctcattccatgaaaactctgtcaactcttgagccaactctttcaaccccgcagcgatctgatgaatatgggatgccacaggatgcgaaacgagggtgtcataggccaaaagacatatcgttgggagcagtctagatcagagtacaacaaagtaaaacacaactgagtacctcactcacagcaacctttaccatatataagaaggtcaacattctcgccaccagtcttgacagcacttagcacttactgaataaagagctgatcgctcgacatgctgtccagataaaacagcgccttagcagcctcttgattgtggttaaacaatggtgtctgtctcgttactggaatacgcttggagttctggttggggacaagccatcatgaaggtcaacagtcgcgcaaaaacaaaaacatcacacggtgtacttcaggaataaacagagggagatgcacgagagtgaaaacaacttactgcccaaagctcttgccagtagttgccagcgtctgccatccgtgcactcatctctcccttgtcctctacccagtctttgggcgaatgccagcggatgaaatcccccagcacacagcctggattggcggccttgaatgcttccatatctactctcgaaaggtcaaatcccatgatagaagtatcggtaaatgtgcaagggcatcctagctccactcctttctcactcaaatcatcggctttgcgtcttccatacccgatatgagctgcgtcgactgcatcttggctcgcatcttggcaccgtcagaggatgatcccaacgtctcaaacaactcttcctgttgttggatcatgtcttcagtcatatatcccggttcctagaacacaaaaaacgaccagccggcaacaacatatggattgagaattgagacaaatcactcttattaactctggattgcattccgttaaaataaacacgcgccttacctgcagtttcgggatcataagtggagcccctgtctttaaaagcttcaggtccttcaatggctgtaggcctccttcgcttttagtctcgtccgaaacttcgcgaggatccggtccactcgagttgacggacgtctgatcaatgtcattgaccaaaattccagattgcgaatcggcgctggacgagtatttcagagctacaaatgactctgtcagcgactgatgccttcgatcatgcatggcatcctcggagccctgatccagtatcgattctgcagtctccatgggatcataaaacacgtcgtcctcgtcctcttcgctgcccaagctttcttcgtagagatggtcaagatggtgagagttgtgtcgacggaggtgctgactactacgccgcctgttcctgaacatttccaccctgggtataggcaaggatgctgtcggtgacgatggttctgtattgactccagtactgtgcgaggacgagtcacgagacggggatgagattgatggaggatcctgctgtatgctggtctctggaggatcgcctcgacccttgacagtcttcaaaagccgtcttgccatgggcacaacgtctgcagacctgggtcgcgatatgtccgaaaatccgtgaagcagattctgaagctgagctccgtacgtcggctcatctgctgctggtgcgctgtttaggcccttcgcctcaggaaattccatctctttggacttggttctgcgtctggcgcgtcgcttcgacatcggatggacatggcccggcgcttccttgttgcggacgatttgtcgggcgatgcagcagtttagcatcgacaacttctgatgcagaagattgtaccgcaaatcgatcgcgaccggcttcttctcttcctcgggacatgcatcaacatcctgtgccgattccttcttgattgtattgctgtactcgtctccataaatatccaccaacggaatcagttggctgttctcccagcgcgaataaagttgcttcaacagctctgaccagagcaccttcagaaagcccatgatagaggtcgcataggaaatgtcggaactgggcgagataacatcgacaagatactgaatcatcctccataggaacgagtcgtacgggaccgtggtggcgtgtctaaaatggagacccagctcggacgctggcacaaggcggatggaacgagcgccgctgcctgttgtgattggctcgcgcggtggatgagaaatggaggagcgtccaaagagtgcgtccacaatgttttcgacatccatagtgtccaccatggtgatagttccctggataagcttggcgcctttgttcaacagagccccgtacgttcgctgctccttgtccgacttttgtcgagctcgtccgccgcctgcggattctgcgctccaggaagatattgcgtcttctaaaataccgctgagtattccatagtcgtcatccttgaattgtgcatgaaggatccagatgtcggcatggctcgcatccatatccgcagtgttcctgctgtcaaggtatcgactacttggtgcacgcgctataaagacagtttgcagtgcgggttagtcttgaggactggccgtgtaaatagtaaaaaactgtaatccctttacaacataccaaatcgcgcaaataaacgcaaggaccgcaggggatcctgagctgggccaaacggcaggcttggaatgggtagcctatacagcgtcctctcctcggttttaatgtcctccatgctcagatcgacgccggacaggctcatagtcggtcctacatcgtcaatgaatggaccgtgcccagtggagtctcctggaacggattgctttgtgtcgttatcgtcagggtttttccaccgtcgccagtcctcgtcataccagttaaccagatcgtagctaaagagtgcggccacgcgggtctggtccttgataccttggccatggtatccaggcgacgagaccgcgctctcatcctcgatgcccattctttcaacaaaaaagtccaaaatgccagcgagactggtgtactgcactggtggatatggcactagggttgtgttgaaacgcgtctcgatcgccctgacatcttcctcgggatcctcttccggatcaggcttcgccacctctggggcccctggtgcctgcgttggcgttgccgttgggtgatggggttgtggattgatcgacagcccggtaaaagtcagattccaaggctgtcctgttggaacaaacaccggtacactgcatccggtattctggaaggcgatagcaaacgaggacagcaggagtttagcagagctgagatcgatgatggcagaagaggaagacatggacgaggaggcaaagatgtcggagatggtgacgggggagataatgagcatgtgtgtcagcgacgtccagcgatggaggctgtggtgctgagtgccgtcgagcgtcgtcggtagaaagtccagatcgatcctcttggctcctgcgctcgctcgggccttggcaggatggtactggtatgagagcgcgtacgtggcgtcgtcgaggctgagcatttccttcagctgatagattggctctgtccgcctgctgcttccttggctttggctttggctttgactttgactttggctttggctctggctctggctatgttggtcggcgcttacttggtcggcgctactttgatcagtgttgctggtggatgtggggtcgcgtgcggcggcaatacaggcagggtcgagaacgcctaggctcctgtcgacgagaccccaggaccttagactgtcctcaatctgagtgatgaatcgctcccatggtcccgaggtggtgtagtcgatgaactcaaagttctcaaagtcgtccatggggcagtgagtcgttccggcagtccttgcgttggcgcgtggtcgagtcggtgggaatggaaagaggaggcagcgagcgtgtggagcatggagcgtggaagagaggcatagttcagacactggactcaaatacgacactgacaccgcccaccgcccaccgcccaccaagtgactgctgaccgcgagacgcgtttttcttttcattttttatcgcgcccaatacactcgcacttttctgcatcaaaaccatctcgcgccctccttcatctcctcactgtctgttacattgcagtccactccactccagcccaggcacgtccagtccatccaaaagcacgacacagcaaatcgactcatgcagcagcagtatgctcaagggtccagtctggacagcacagccaagattctggtcctcggagactcaggcgtggtaacaccaactcgaacaaaccctcgtcgtatcgaaaccgagcacgcaccccaacgaggcaccttcactaaagcccatcatcgcgttatctaggggaaatccagtctggtccatgctctgtgccatagcgagcccctccggtactcgacccccaccatcggctgcaatatcgacgtacgacttcactcctccaccattccttctgctgccgcaacctcatcagcgcgctctaccaacccctctctcctctccagagccagcaatacctctgcagatccatcagcatcacttgcctcgggcggtcttggcttgtcagaacccaccttcatagagttttacgacatttcaggatcaccgtcagtacggcatgaaaagtcgaggacgatgttctacagagatgtgccgtatcagggcattctcctggtccatgacctatgcaacaggaggagctacgacaatctctggaaatggattggagactatctcgaggcatcaagctcttctgctgctcctaggtggccaagtcaacagcaaggtatatgatgcatccatgtgtgtgtatgtacattacggaaagaatacttgaaccccatctaaaccctcccattctccttcgataaccgcgggatggattagggttcaacagcacatcacatcacggagctcgatctggagagctaggcatcccattactggtggtcggtaccaaaaccgacgtggccaattcaacctatgatcaacacaagagcagtctatccacctcgttcggtcaagatctggtcgacaagtacggcggcgaagccatatcagtgtgctcgatttcacccgcagagtttatgcccaattcctcgaccatgatcgccttcaacttatttttcaacagcattgttgacccccgttcaaccgcagcaacgtcctctcgttcaagaaacccgtccgcaaacagtcaaacaggagcgtatgcacccgcgagcacttcacgatatcctcgaccgccacccactcccacgccaggggaggaccctcagctgcagctgctacagcaccgccatccttcgcagccacatcagcgccgaggttcgtccgtggacgaaaaggacgactatggatcatccgggattcccatcatggactttgcgacgtttacgggcggatctgccacgagccatcagagcccagaatattaccatcagcaccaccagcagtctagtgcaacatcgcatggtccaccttctcggtcacgttctccttttgatccagccggtactgccatgcctccagcgcggtctgtcacacccacaggattcagtagcactctctcgacgaagagtgcgctccgagcacagtacgaacggaatcggagtgtgctgggtcagtacaacagtaatctaggagtgctcacatataccaatctcagcagcaagggagggtcttccgccggtcgcacacactgatgaaaaaatacaaaagagacaatccgcccctcaccttcgtcaactcgatcagcggcctgtgattaaatatatgcgtgtatgtgtgtgagtgaggggatccaagagcgtctgtccatcccttgggcgaggaacctgcatccgcagtgccgaatcacttcatttgccggcgggagggcttctttgacatgccaccatgccatggcttttttcgcgtttccaaagaagaaaaaaaagtcaacaggaacgagattcgtactcctaacccatgatagagttacatcgcacgggcggtcactgcaccatgatgtaaatcgttcgtctaggaacagtggctcgaaacacaatggccatctcctccgtcacctcgagctcagtcgcagagtccgtcatcgcgtccaagagaactggctcgtgcttcctggcagcaatcacggggtgggttcacgcgccagagcgcgagctcataagcagaggcatcgtcaaaccgaggtgaattctcgtcctttgatgagacacttgagtgctgtccaccgagtccgcatgaaagatccgaatgggcaatgaatttgaggtgaagtctctctcaacaagactgaacaggttcaaagagatggttggacatgtctgtggagtgagagagaatgggggaacagactcgaggctcgttggcgagcggttgcaggaaagccactcagagccgagctgatggacgcgtccaaaatggaagaggggcaggcagtgttgacggtggttgtgtgggcagggtgttcagaaaggcattttttctcaggatgatatcgaccatgcatggcggcgaacatggcgatacgaaattatcggtgcgtagagggtcttgcttatggcatcacagcccactggacattccatcttgcactaaagtgggtttctactcactcgcaatcaaagactgaaaaagaaaaaaatccctctctacctttgacatacatcaatcgatgtcgtgtacgagtgtcatcatgcacagcagcgggcatgcgacgagtttattcatgcactgcagacagatgcagaagagtccaagaaaaaccgtgtgtgagaaagagaaagacgcacactcagtaaaaaaaaaaaaaaaaaaaaaagggcgtccgggcgtgcgaaggggtgtggtttgtatcgcggttctttgttgcctttgtgctgatgctttcttcactctcctttgctacactaatagtcagccctcctcctaagcaataacctcgtaaccagagttgtgttcctcacgaccaccaaagaggctatatagaagaacagaaagaacggcataatcccgtcagtcatgttttggctctcgattccatcattctcagtgaagcttctttcacaaggttgcatagggttgcagtatacgtacaagtagatgatcagtccgagaatagggaacaagaagataagaagcgaccctagttatagaagagagacatacagaaagagaccgagagcgagtgagaaagtgttttcgacgtgagagagtgaacaccaacaacaacaaaaacaagcacaaaaaaaacgccaagagccaacaaaagcttttcgccagcgccgcgtctcgttctcttggccatgtcccgcgggtccttttttcaaaaaaaaattgtcgacattaacgtgtaaagtagcgaggcttacagaggagcttggaggtgacactgcggttggagttgatgacttcaaagatagcaatgaggtcgagaatgaagatcacctatgggaacatgcaacaagtccataataatccgtttagctgcgagaagcaaaagagaggcgacaagtggttttttttcagacaagaagcaccgcatggcgacgacgacaatggtagtggtggtatgcttaccaggccaaagaagcctccggtgtaggttgcgggatgcatgtctgttgtcgattgaagcggaagggggaaagcgttaaggaggaatgaagtcaaaaaaagaagaaagagtaaaaaaagccaagaaaagtgcgacggatgagggaaaaaaaatcgcgtgcgtgcacaaaaaaaccgaacgatgtcattgccatcaaaatgttgaccgcggtcgacttcacctccgcctttcccgcccattcttgctcccctgctttcacctctacgcacccttttcgtcccattcccttttcttttgtttattgcgctgtgcagaaagagtgaattgtgtatgtagaggtgtattcgactttctttcttctactatcttttttacattttttttctcccgtttcttgtttttacaaaaccttggcctcgttcttgagcttgtcaatcaagtcgtcaacgctctccacaagcttgccaccctgtctcttggcaggctcagcaatcttcaaggtctcgaggcgaggcttgatgtcaacaccgagatctgcaacggtgtacttggtcaagggcttcttcttggccttcatgatgttgggaagcgatgcgtatctgggggtattgagactagtacagcagaaaaaaaaataggaagaaagggtgttaaacttgagccatcgttaaaaagcatttgccacagaatatctatatgcaatcactttaccgaagatcggtggtaagaatggcaggaagggcagtcttgatggtctcgacacctccatcgacctcacgagtgacagtcatggccttctcagagagctcaaccttggaggcaaaagtggcctagaggtgtttggtgtaggagagaaaaggagttagatcataaatcatctcgacctgctaatcggctcttctgtatccttgctcctcgcttttcttcaagtcctcagtgtaaacatgaatgaatcatgggtagtctgctcgtctatccagctgcaacgcctctcctgtatctgcaaagaaagtagctgcaccggcgatgtagccgagtggtgccgtcgagtcacacacatcgttcctgaaactctgcttttttggcggtcactgatttttcacacggataccacctaagaaaatgacacatgagccaacgaagtggagagggagagggcgagagagagcctctttacctggggccagttcaagagaccagcaagcatctgtccagtctggttcgagtcgtcatcgatcgcctgcttgcccaagatcaccatatcgggcttctccttgtcgatcacagccttcaacaacttggccacagccaggggctggagctcctcgttgctctcgacatggatggccttgtcagctcccatcgccagggccgtcctgagcgtctcctgggccttggcaggtccgcacgagatggcaatcacctcggccttgccgttagccttggcaagggcctccttgatctgaatggcctgctcggctccgatctcgtcaaaagggttcatcgagtgcttgacgttggccgtctcgacagctgtgccagcagcattcacgcgaatcttgactgcatagtcaacaacgcgcttgcacgcgaccataatgcggaggttggacattgttgagggtgttgcaggaagtagggacaaaggggaatgtgagaggggagaagacagagagggagaggggagtgaaggatgagacaaaagcgttgctcgaaaagatgaggaattagatctcgctgatccctttttcgtcacttccccggatatacgcgggggatcacgtgtaaatgctacattttatatttttttacaggacggggtgctggccagcgatgtgcgcctcatcctgctccttgatctgatcctgcagcatatctactcagtcatcatattgaagaggagagaaagacgataatatcattagtgaaagggttcagcgactatcctgcattgatgtgccctgagcaagccaagaaaaatgataggccaattgcgtactaaaccaagtggctccttcaacagcaaagccagactgtggcgacccaggacgctgctccgacataaagtcaatgctgtccgactgtcctgatatccgattgaacgagtcccgcctagcatgtaccatagacacgaaaatcgacattgcataagtaccacaccctagatcagacagagcagagcagagtcgacaagcagcccacagatctcagggtacgtactcgtaaaaatcccatccaacagaatcattagaacctatagagagcatggtgttggtcgaaacccctcccaaaggagatatatctccgtccgcgtgaaagttggaatggcccttggagaaatccaacaggggcgacggcagaaacgacgatcgcccagtcggagacgacgtcagcatcggtgaggtgtcctgccgagagctacgcagctcgtttccaatcgatgtgtcaatcacaatccgaggcacctctggcctcaacctcgagctttgctttgaccgcctctgcttcaaaaagcttcgccgcgctacaatcgtcatgagcaaattatggatcgtctctcgggccaccgctgccttgatttcctttacacggtcgtttcgcttgaggaactcatccatactagtatcaatgaacatgaaaaaaaatcaaagttgtgagggggggtgctgctgtttggctattgggcgaatgaacatgcgttctcaacaaacttaccctagtgcctgctcaatgtcaacgagggtgaacgagagaatgtccaagatgctgtaaaacgaaattccacgagtggtgcaggtcgccatggcctccttgtagacaagattgtagatacgacgacgacgatagacatccagggtatcgactctggaaagtgattgctgaagcccctgcaagtccaagttggcctcgagcacatgcttcttctcctcggactgagaggactctggaccagagacggtgatcgaaacagtcttgggggaatggcctccaccatgacggccgctgggagtgactgacagccgactcaaccttcgccctgacccaagaccgaatactgatcggtgagaggaagctgcaccatgaagagacggtgacggcggagcgttggggttgttgaggtcctcggtcgtggaagcagaagctggcggtcctgcaggtccaggagagacagtaaaggtcttgaccagattgggcacactgtactctggatctgcataaactctggtacagaaccgtccttccagcgagcgtagaaactttgagaggtatttcgggttgaaatagccggtgccctgagggtcaaactgcgcccatttcactttgaagttcctcagatcctcccgcgtaatcaaggtcgtcaaggagtcctgctggtacgcaaaggaaaagttgctgatgatgaccgcaataaacatgttcagcagaatatacgtgcaaacaatgtagaatgagaggaacataaagtacgcccagggctgagatccacagtcgctgtcaaggtacgaggtcatgctgggcgtgcacaagggccactccaccatcatgtcatgcatgacaaagtcccagttttcccctgttgtcatccgaatgagcatcagcatcgtgttcccaaacgtttcaaagttggcggtcgcagtcgtcgaaggtcctagacgcgtcatcccaaagagttcccggaacatgattgcatagaccgtgaagacaaccatgaagacggcggtgatgttgatgatagaccctagagcaatcctgtttgtatatggacaagcgcatatggcggttaagagaacgaacagagccaaggcagcatgcttttcatagagaagggcgtacttacaccaaagcacggaagagcacctgcaacgaatcgattcgctgagctaagcggaatgagatggtgatcagcagaaacttttccaggcgcagggtccataactaggtcgataggtgggtgcacacaggtggttgtcagtaacgtttagtctattagactcgcgagtcgtaccacgcgtgtttgatgagtgtccatacctgatgccctatgaagcgaggtataagggtgatcaacgcaagagtcgtgatggcaaagtcgtacaaattccagcgcgacagcctccactgcgaccgatacgaaaaaaaacacggcgttagaagttagaagggggacgcaccacagcgactgacagaatgttcagcgatacgtgccaggatgcactctgcataccttatggaacccgtagccgcacagcttgatgccaatctccacggtgtacaagccaagaaagataaagtatgagatgtcctggatgtccgtgagcagcggcggctggtcatagtgctgcgaggcaatcagacagacattcagcgccagaacagcggtcatgcccttccataggatgcccttcttctcgatcaccatatcgtagcagatcgccctgaaccagttgcgtggtcgggcgggtgtagctgtcggcttgatcagccgaagctgccgccgaaggtccagccagcgacgctgctcgaccgtcaggagcgagatgccgttccaggctttgaaggtctcgaggatgactccgataaaaacttgcacaaagacaatcgaaccgattaacatgaacagcagaaagtagaacgagttgaaacgattgggctcgtctgtctgaaaaaaaggttgctcgccaaggtggttgggtactgcgcggccggaattcatcaccaggatccatccttcctgagaagccatctcaaagagcgtcagaacggcagcctggatggtatcgaagctgtagtcgtacgggtttctccaggtcctcgagatgagaatgccgatattatcgttgccgtcaggcttcttcatgaactcgcccacacactcgctcttggtttggacgctgttatcgttgcacgagtaaaagtagcccgcatagatgttaacgccgtagatcgcgaacggccagaacagtagcgccgtcagcactagggcgaccaccatgcgcggcaaggctttggcgatagccctaaacatggccgagacgccctcaaagtaccggacaagacggagcactcgcagacaggacagagctcgcactgcgcgcgacacgctgtacagatggtctatctgtgcaaaagtcatcacgcagctcatgaggacaatgaacagatccaaaaagttccacaggtcacgcaagtatccagtaggcgtgaagacaagcccatacgcaagcacacgcagaaactgctccacgacgaatataatcgtcgtcgcgtagtcgatatcgctgagaatgttgatgctccttgcgtcacccgtcaacatagcccgctgtcggtccactggatcgtccgcaatgaccacagctatgctcaggatgatgcaggcaaagatgagccaattgaaccagttcatggtccccaggtgccggcctgtcctgggtcctacgagtcgacggcaccattgtcggaaccgattgttgctcgggaagaggaacagggagcgatcaaacattgggtgggcctccagaaactcccttgtttctgtggcccgttcgtctcccagcgcacgtgcctgggccttggcttggcgatacccctccagcgacagtgtttccgacgtagccctgaggtcgttcgtgaacgaggagaggattagacgtttgcttcatgcacaaccaagagaatggcgaatgactggcgaaagactggtgagacttactgagcatcatcaagaggcctgtccatgtcccaggtgatcttttccagcccagcatccagcctctccagactggcatcaatctcgtcctgagttttgccgaagcctgaccgcccagccaaaagttgattctgatcgaccttgatcgtcttgactggcaccttggcagcctgtgccgcctccagctgcgcttgtgttggaaaccagtagtcgcgggcgcgctctaaccagagaatgactcgccccttcgactctacgatttcgcttgtattctatcaaagcttaaagttaaaatcgactactcacccattgcagccatggccttctcgattactgcagccaaccaagcgctcagctcttaccggtgcattgtcaccctcgagaaactctcgaaagatgttcttccggaccactactgtttggtccatgggcaggccgtacacagagagggtctgcggtcgtgccggtagataggcataggggttcaagtatctacagacgcgttttgaatttttactgtcagtagcttttacaggtaggaaaatgaacaactcaaaggagttcctcaacagctcaatgacttactgaaaaataccatgcgcctttgagttctttaagcgctgatgccgttcaaaatacatctccagttgtttcctgtacttttcatcgtcgtccagttcaaagtgctccagcacaatggcaatgaacaggttcaggaggacgtctagttgtgtccaagacaaaagcgaacgagttagtggaaccggtaactaagctcgctactcgctgatcgctgacagccttcgcacatattcccaggcgacatacaatgcgaagcgcagtagtagacgacgaaaaagatgacagcgtagaactgcttgtatctctcctgatgtgcctccagtccctcgtacatgacgttgacccaattctctcccgtcaaaatctatgagcgacgatattgaagaagcacactgagtatcaagctcaacccatcgccaagcaaacaaaagctgttggacagcacctcagaaccttaccacaaagagcgagataaagctctgccctagatcgtcaaagttgatcggctggtcctcatccgacaccatatcaccaccaaagaggaacatgggaatcggggcgcagaccagcaggaacatgaatgtgatcaagagcagattcatcattcccgtagcgctaccaatgatggcccgctattattcgatcccaaagcgtaaaatgaaataaagtagtcagcatgcacgctcatggctctggttatggtgacagcccatcgcaaaccacctacgacttaccatcaaatctcggaccccgggtatggctgggatcaggcgatacgctcgcatgacttgaaacaccgtgagataacgataccactcccactcttggatcacaggcaagaggatgatggtcgtggtcagggccaggaaaaggtcgaactggttggacttcttcttccaaaagagcttccagatactgtggccggctatccgtatggcgatctcgagcaggaaaaagaacgtgaacgcgatttcggccatgttcagtctcttgagctcctcgctcgtgctgtcgtagcggcggaagcacatggcgagcaagttgaagaacaccacgacggccccagctatagggaaccacgggtcgttcaccagacggatgagccattgccgggcaggagagcgaacctggtggatttgatcctcaaactgccacccttcggccgtgtccaggagcgttcgcttgcttcgcggcttgctggagaaggccgagtgtcttttctctgctctcacggccccgaatgaataggtgataccggctatgtgaatgaaattgaagaggtgagaaacagtccgagtagcgagaatgacttttaaacctcagctactactcgcatacgaagcccagtgcggtgcatgcttaccaatgaacaaggggatcatcaagaaactcatcaagaagatggccacgcaaaagaatatggccgcccaccttgagtctccatccatcacccaatactcgacatctgtccacccttccagggaactgactgtgaagacagtcagcaatgaaaacagaaagttgtcaaaggacaccaagcccaaagggttgtagtttggaaactgcatgcagacctgtccttctgggcaaatcaacccagaggtcctgggcaatgagttgtcgccgtcgccctgtcctacgtaattcacaattcctttaatagtgccattgctgcgataccctccacaaaccatttcgggtgtgacaggcgcccctaatatgaacgatgaaatgtgtcagtcatggctacgagatattcagcaggatggcatgtgcggcacttacaggtattcacattaacagggtcctgaatggcacaccgtctcgataatgatccttggaacacaagtagtccaataagactgaggatcaagaagaagaagaaaatgaaccccagaattgtgaggagcagcggtgccgacattgacagcgagtcaatgatggtctaaggcgtgaatagtaggcgcaggagttagatttgacaacggaggattctggcgtctcagcgtccgaatactatagtcatagcagcttaccgacgttccttcggtcaacgacaacaaacgcaaaggccgaagggcactgatggctttgaagatgtagatcctctcgataccagtcatcatgaaaccaaagtcgacccagtagctgatgacgactattccatccaaacggttatagtaagagcggaagaacggagcgtgtgctggtgagccactcgtctccaaggcgtgcacgctcgcgttctccatggtttgggcgcaggcgctgtgtatttgtatatcggacttctcggccatcgatgaatgggactgtgcactgttcacgcgcgaaagcgagtgcgaacgcttaaaaggcgcccgtgaggttttggtcgtagagaagttgttgaacaggggtactatccatggaaaacgctttcgccatcgaggtccgttgctgtcaaagaagaggccgtaaacgatggccttggatataatttcgatactgtataatgggatagaagagggtgtatcacaatggtcaacagatgttgttcaagctacagcagaagacgtgctttgttgcggtgacttacgtgtacaagatattgattgctaatagtccatagtgggtccagtacgaaccaaagctattcttcacgtcctcagtggtaggggtaatgacaaagaacacccactgcgtgagaatgaccacaagaataaatggatcggtgtatctatagggtgcataaaaaaataatattttagactaacggcctgatatcacacacgttgaaagtcgagaaattattccggacatactttgacatcagtatcgacgccagcttgactcggagagggttggttggtgaaaagatcagaagcgaacgtccttcgagccggattttgtcgcctgcacgatgagcgaaccctcctggagcaaatgacggctcttcctcatcctgcacccctctctcctgtatggctgaatgcgacttgccaagatgggacccgccagagcgggattgctcggagcttttgaagaggccacgggttccttgctgcgagctacgcatagctaaatttgatccgcctgcacctgaacttctcttcgatcccaccctttccatctttgctgatccatgatcggagccagcaccaagggctttgaaagacagtgcgctggtcgatccctcctgatgatatgagtttctgtgctgacggacgagctcagcctgatctccgtcgctatggtcggcctgcgaatgaacggaggagcggctcggctgctgctcttgtgctctggaattcaccactctagaagagatgcccgtcatgacatctgaaagtccgtgcatccaactccctggctgctcagttcctggactcgcaggaggtccgactatggacgagcgattgcgcgctatggatgaccgctttgataggacagggaccaaaggcggcgatgctggtctgacaggcgcccgttcccgtgtggatgacgttgagcttctcgagaccatagaatgtgatcggggggcgaggcctgaggagtgaccgtccacgttgatggaggtgtgccggcgccgccgtaagccggcttcattgtcactggagggttcagagacgccaggatcgtagaacgggtcagcggagaggttgccatgttcaagactgtggatggatatatgactggtgggtgaaaacgctgctggctgctggctgttgaactctggcgaggagagtgaggcggctcttggcttgacctgcggcgggcacagagtcgctgctgcagtcgcatgggcttgagcttgggtcgattcggcatgagctggcgccgattccgtatcgcggtcgttgggtctctctgtgtgaggatgctgacctgtcattgcctgtgattaggcacacgcatgtgctacttgcagctgcaggtcccttggtgcgaccaagacgaatgaagacctggccagcaaaaacagctcaataggcccagcagagaacagacgacaggcgcgtgtgtgtgcgggaatgccgagaggcgagggtgtgggcgggtggagagcggcaagggtgccacgaggcgtgagagagagagagagagagcgagagagacggtgtgggatgccaggaagagacgagacgggatgcatgcaacaggcggagaggcgcaatgggatggagcgaaaacgtgggccacatagtatgtgcacactctgcaactcttttattcggcctatcccgtacgagagtggtgtctctcgcagtgtggcagcagtacgtgctcaaccaacggatttccgtattgaaattcggccatcgggcagaggacgttcttctgcctctcattcagcccacatcccttttttgctctcttcttctttcgctctttctcacattctctgattctctcactctctcctgatcacccatcaacccactgctcactgctgctcttctcctcgtagccttgtcactctgctgagcgcgtacactcccgtcgtccttccttcgcaagcaaaacgacctctcccgtgtgctcgcaagagtcgcaaccccccatacccgtcattcagttctttgaacaggtctgccaccaacacccacctcagcgccaacacaatgcgtccctcgcattccgctaccaccctcgccgaggacacctctgctcccagctcccagcagcaccagcagcagcctcagcgaattcttgccaactctgcatcccacgcctcgttcaacacctctgctactgccacacccacacccacccgtcggccgtttgcaaacgctgcctaccgctccacaggagcagactcgcaggcgagcttgttcagctcgtatgggcaccatccaacctccaccgatccactcttcctccacggcccgtggtttaaggacaactcgggccgcacagtgacgctccgcggagttaatctgtccggtgcctccaaaatgccggtaggctgcccgtcgcacgaagctgagggcttcctggacgcggatggcacgcaggtctcgtttgtggggcggccgttcccgctcgaggatgcagacgagcatctttcccgactcaagcactggggcttcaatctgctccgcttcatcgttacctgggaggcgatcgagcatgccgggccgtaagttgtttatcgcgcaaaatgaactggttgcaagtggtgtttcgtaatctctgcatcatcttgccatatcgcccattgcgatcatcccctttggagagagccaccaatgggaggcgtcccttttcttctttttttcattctctcttttcaatgtgctgtctgtgcggaggggctgccatggacatggcttggtcggagtgctcgttctctctctcactatctcaggaacagaacgtctctccctcatcctcacgccacaccgcccgactgcattccctacagcccaaccttcgtgcaaaaaggcgtgcctgctgcacaacatgttaccaaatggccgatttggctcggacgatcgcctggtcagggtggtcgagtgacctccttcgatattcacgcacacaccttgataattacgtcgcgagctgtggaggagaaaatcaggccacttttttctatcccttttttttttgatcgtcgtcaggttgtgccgtgatcttagcaaactctatacgcccgtgcatctatccttcacagctaatggcacagacacgtcgtctgtcactcacctcactcggcgctcactctctacccattgtagcaggccagccagccgactgtgtgtacactatgagccctccgtatccctgctgacccaaccccttctcatctcttcaccctgcctgatagtggcaagtacgactacgactactttgagtatctgatcaaggtcttccaaaagtgcaagcaatatggcttcaagtgccttgtcgatcctcatcaagatgtggtgagtttaaagtcctgcacgcagcggcatgctatcaagacgttatctataaatgtgtgcagcatactaagctcactctttgattgtgtatgatagtggtcaaggttctctggcggatctggagcgccattgtggacactatacctggctggactcgaccccagctgcttcccccagaccaatgcggccttggttcataacttttacgaggattcagaaaactttcccaagatggtgtgggccaccaactacaacaaattggctgcggcaaccatgttcacgctcttctttgctggatcgacgtttgctccggactgtgtcgtggacgatatgaacattcaggactacttgcagatgcattacatcaagagctatatggctcttgcagagtatatcaccgcacagcacggtatcgaggatgacgttgtgatcggttacgacaccctgaatgagccttcggcgggctgggttggcgtggaggacgtcacaaagttcccctctcatcaagagttgaagaaggatgctacgcccactccactgcaagccatgattctcggccaaggatacaagcagaccgtcgaattctggggattcaccttttttggccccaagaaacaaggttcaaagtcgattgatcctgagggtgttacagcatggctctccaaggagaaacgcgaggaaaaagatctacggtttggatggaagcgatcgcctcagtttcctgcagcaggccggtgtatctgggcccatcacaatgtatgggacatctcaacacagcaggtgctcaacgcagagtatttttacaaggaccccgaaacaggagaaaagtacgagtttgattcaaggtcgtttttgccgttctgtcgccgattcgctcaggccatccgcacggtccacaatgctgccatcatcttcttggagccacctgtcaatgagataccaccctcgctgccaccgccccacgacgatgacgatgttgcccagttcgacattacctctcgtgtggtctatgcgcctcattggtacgacggactgacgcttttgaacaagcgatggaactttttcaacattgactatcttggagtgaagcgaggacgataccccaactatgccatggcggtcaaaattggcgacaaggctatcagggaatgcttcaggaatcagctcgcatggatcaaggaggagggacaaggtgcgattggccagcatccaacagtgatcggagagattggaattccgtacgacatgaacggtggcaagtcctatcgatccaacggcaactacaaggatcagatcaaggccatggacgccaacatgtacgcattggaatctaaccacctcaacttcacgctctggaactactgccccgacaacgttcacaaatggggcgaccagtggaacggcgaggacctttcgctgtggagcaagaacgaccttgaccgggacccgcgtcgtctcagcaagaaagccagtcagagcagcatcgcgagtaacgcatacagcctccataaggttgggtccgagagcgcgactggctcatcgggagacgttgccagttcattgaagcaagactcgccatcattaacaaggagatcgtcgtctacggtctcggtcgaccacaaacagtcaccagttcatgctcgcgtggcgatgctcgcatcacccttatcgtcctccagttcctcaaagtcctcttcttccacggcgtcctccaacaagccgctgctcaaagaggtcgactgcggtgcacctgacgtcgatttgaacaacggcggaagagcactgttggcattctgcaggccatttgcgcaaaaggtggcgggcatcccactggagctgtccttttctttgagcactgtgacgttcaagttctcgttcagaaggacacctacgacggatcccgagagcggacctgaccctcttaactcgccccggcctggcaggattgatgaacccacactgatttatttgccgcggatccatttcccatgcgcagaggaatacctgaactctttggatgatgctgcgtccacgcaacagcaggcgaagaatgagcctgtctgctcagtgaccgtctcaggaggtcactggaagtgggagcaggatgagcagattttgtactggtggaccgaggacagtgcagagacggactacctgacacaggatgacagcaagggacgcccgtcctcggatgagcatgtgtttgagattgtggttgtaggaaagaagtgggccggcaattcactcacccgatcgaaacgatccagagtttggagtactgtcagtcagtgctgtcgactttcgtaagtccgacccttcgtgcgagactttcctggtcagccacggttacccacttttgttgttctttgttgtaaataaaaactctcgtatgtacatcccactatcgctgccgtagcttaggtgaagacgtttcctcggaactctaagacggtagcacacgaccgtgggagtgctcgagactgaagtgttgccgcgagaacgcggcgtgcagttcagggatgtgcaagtgtgagagaatggacggacttggtgtgacacagttgccgaatgcttttgccaccaaagcatatataagctgctgttttgtattggacttttgcaatagcgccgtgcggcggaggcgtggcgatgcattatgataggctgagagccaaaggcagatggcaccacgccgcagttgatgtttgtacaacacgcccttggccagggaagaggacgggggggcagacgcgttgctcgttccgcggacgagcaattgaagcacacgccgctttcgacgtgggaatgcatgacctatcaaaggtgcagccgcacatacgttgtagtctctactggaccgcgcctcgaggtctaggcaactatgttgtaagccgcacgtccagcggggcatagtgccgggaaaatatgagaaggaagaacgtatataaggaaccaacgcgtctaacagcatcttgcatcttttttcttatcacaaaaagcaccagcaacctcctcagtttttcaccactacttttgtcagtttcactagtccctagccatgcgtttttctgcgatcgtcatctctgttgccgccttggcctgggccacttctgcccagaaccactgcaaggcgggcgacgggcaaaagggtatctgtgtcgggtaagagcgctgttgtgacgtcttgcttcggccatgcaggatcgccacttctcctcgctgataagcgttttctctttctctcttggtgtctagtacctcttactgtgccaatggtggtgggcgctctaccccaggatactgcctcaatgaccccgtaggagtccagtgctgcacgtacgattcctgcacgatctccgatagcaaccatcacagtggggagtgcatgcctgaatcagagtgcacccatggctccgtgttcgccaatcgctgcggtggccctgcccagatcaaatgctgcgttacgtccccaccctatgacagggactaaggccgaggcatagcccccgtttattttgcatgcagcacgcgttgcactgaatagtgaaaataaaaatgcgagccgttgtgcttcctgcacgtgcccagccgttcgatccagtccacatttcctgtgcctgcagcagaccctttttgcttcccgttgttcttttccactctgtgatccattccgcccctcccatccctctgttcctgtgttgatcaatctctctcgatcgcacgagcacgcatcacaagcagaagcatccgcccatgtaccgtgttgctgctctgtctcgggcatccgtccgagcaaatgccgccccgcttccgttagcgcgtcggcaggctctccttgcaccctgcctcactcgcaccagcaatacccttcttcgcatcccctctgcagcctcatccgcgcgtcagctcagaacagtggccacagtctctgtggcaccacgagcagcaggctccctacccacctcgagccttgctgtccagccgtccccgtttctccgcacgagaaaagtacctgggggtcagacgttgcgacgcaaatacacgaccgagaccccggtcactgtggaggaagaggtacataaatcactcagctacgccctttttcaaagcagcgcacttgactcgatctcctagcggccgtttgtgtgtgtgtgtgtgtgtgtgtgtgtcgctctgcaagtattatcattccattaacatagaagaaacgccttctgctcgctcgctactgaactagcttcccctgcaatacggcatgctctacttcgacaacgcctatcccctcaagatggggtggtgggatgttcggtattcgctcttgaagcccggctggaagtccctggagcgcaaggccaagatggaactcattccgcccgagaacgccatgccctttcacttcaaaatcggaggcatcgagccaaggtaaacatgggcagcaagcatgagaagaaatggaaacgcgagagtgacataaagttccaggtcctccagtgcccttcgcttacctaaatttacaaattccctttctggtctttttttttttacctcttcactattatggcctcttcggtttccatgaattcgtaggctgaaggacggaggcatgtttgtgcacttctcctacgtccatccaagctcatacaccaccaaggaagccctcaaagagatcgagagccgatgtgaacagcacttgatcagtcatggacattacatgtggtttaactttcaaaaggttcgcgcgttcctcgtcaagggatcgcctttcctggaggacatggccagtcggtatcccaacagcaggatcaggatcgaatacacgggcgagcccggtgtggagggtctttattcgctcttcaggaaatacggaaagatcatggacatcatcatggtcccacctgtcaaggacatgcctaagcaagccatcattcagtactcggtcatgcgtgcttccacaagcgccaagagctgtttgcacggcgcagagatcaacggcgttcgactgagcgtgacctatgagcggactctgaagggcaatgccatctgggactggctcaccaaccaccccaggatcacggtccctctcggaggtatggccattgcaggcatgtccttcatgatctttgaccctatccgcgtcttcagcatggaggccaagatcacgcaattgttcaacatgaatgagtacaagttcttgaggtggctgcgcaaggagacggtcgggcggttgaccaggaccccaattgactcgctccaggccacgggctggcgtgagagagagcacgacgaggagaaactccggagctggctgcgtgttcccccagagtccttcgcgatcgttcatggacctcgcggtgccggaaagaccgagatggtcgagtatgtgatcaaggataagaagcacaaggtcgtgatcaaatgcgaggagctggcaaacgcgaggagtgagggcgaggtcctgacgaatctggcgaagcaagtcggatacattcccttgttccagttcatgacgaccatcaacaacatgatggacatggccatcaccgcaaccacgggacaaaaagcaggcttatcagcgacgttcgagggacagctcaaaaagattctggacacgctgacgatcgctattcaggaggcctcacctaccaaggacatgtcgtccttctcacccgaggcgatcatgaagaagattgaggccaccatcgaggaaaagacacgtcgtgccgagatggtccagtctggatgctccggcagcaccatgtctctggaatccagacgagctgccaaagccaagaagagaaaggacaaggaggagagccattggtgtgatccagatgagatccctgtgattgtaattgacggatttatgtccagggagaagggtccgcatgcgaaggagctctggacgcacctgtcagagtgggccgccgttctggtcgagaaccacgttgcccatgtaattttcttgagcaacaacgttgttgcttccaagcccttggctaaaggtaacccctcttgcgtactacaaacatgggatccagcgcgaaacgcaaagcgtacttgttttctaacgctcctttctcccttgcatctcttcctatctccaagctttgccaaacatgacgttcgagactattgtgctcgcagacgcaacgttggattccgcactcgaattcgtttacaagcacttggaccgcgacgagttccccgacctgatcgagtccgtgcagaccattggtggtcgtctcacagatctggagctctttgttcagaaggtcaagagcggtatgggacctgaagacgccgtccatgacatcctgggccgcgctgtgattgaggtccgaaagagcgccttcgactttgacagcacggacggacgaaccctcacctggacaccgattcagttctgggcggtgatgaagcagctcgccagcagcgagcttgccaactttgatgagctcaagatccaccccttgttcaagaacgatgagtcgccttttgcggccatggagcaggcagaactgatcacgatcgtgcacaggaatggacggccagcagccgtgcggccaggcaaacccatttaccgggctgcgttccaagacattctccaggacattgggttctcggctgtgatggagctcgagtctgcgaccttcttggagaaggaggagatggtcaaggtggccaagtgggaggccgagttgaaggagctgtcgaacttgctgcacaaggatggctcgtggatctttgggggaggaagagttcccaaggaggttgatacccgcgtcaagtggctcatgaagaagctggccgagtcccacgcaaaggtcgagaagtacgagctggaggcggccaatgcaaagaaggccgtggctagccttagcttggctgcatagttttagacatacgaatgcatagaaaaaaagtcgcccgtcataaagtaaccctttttatataaacctgtgcaggtattttgccctctggcttcctgtcacggtctcttttgtctgcagagaaaactgaggaccacaatgtgagactgagttgaaacgcgtcaacagcgcgttaccattcacctgagtttcgattttctttttttttttttttttacccgccataaacttagtcttgaacgttgcatccagtcatactgcagtgaaccgaacatggcgtcgcagaatgaacaaagggattgcatgaccagagctcctcaatcccgatgccattgcatcactctttgggtgaactgaacagcgatcgcgcttaaagatgcatccgagggtatgaacgagtgccttggtttgttgcggttgcgaagtaaagtgatggggatagcaaaactgagagaaggtcgaggtcagcaaaacttttaacgataatgcgtcgagcagtgtgggacacggcctcgaaccagttgcaagtacatgtagtatttcatggcagagatttttttttttcttaattatgatgaaaaaataaaaaaagaaattcgagtggtccccataaaacccccgcggggaccactcaggatgcgctacaacactcgccaccatagtaccacggcgccatgatactacaatgtggtgccttagcaacaccccgcccgccagacctctcaccttcagaggtgccactcatggccgtgagcgcgttttccctgcctcttgcagactggagaccagccacgagagcggtctgacggaaactctgaggggtaaattttgcctgtcgagggcgggtatttatattgtttttgcgctttcgagactgcctccttgggttgcacaatggttgcacaattcgttcatcgagttatgggttttttgtctatagttagttcgagcggaaaacctgcagtagtcggcttgccttgactgctttttcctgtcaatgccttgttcacgtccttgtatcctcaccgaccacgcctcggtcttcgttccaccttgcaaatggcagctcatctccttggcaccgtcttgaccgcccatattcagcagtcttgaaactattaggcttcggtccaatcacaaatttccaattttcaaacacggcaacgccttgctcacagctccgctcagcaagtgatactgtattcctctgcaaaggcgaccgtctgatgcaacatgaacggtgtcttcatcagttgccttgcctgctgcctttgaaatcgatcagcactgacgcgtcggctgttcttctttatcgatagctgactcaccaagcactcagtcctctctctctctcgcgtggatacccccgtctccaactacctcatagaccctcgtcaatagttgcttcaatcttctcgatggcatttactctagaacttcgcccttgtcaggttaaattggacccctgtatgcacaaggaaagggtcttgggcagaaaagtgtaatacgtatataacggcggtactagtatggatctagagaaatgaacctgcttaaaaaactgtgctgcgacgcctcctctactgaactagcagttatacctggggagcggcctattgcacaaccgcggccttacccctgcagctgtcaaagaacctaaagcacacgccagtcgatgctccacagccgctggcacgcttacacatctgaaggaggacaggcgccgtcattaaaatcgagtatattcgaaacgcgacggtgcgagcctggtcatcatcgtttacactcaacactcgctgtactatttatagagtctctcaaatttaaagtccagaagtcactccactttcaaccgtacatgcgctctggcaagcgaaccttccgtcaacccagatgtcttaagggccatggaagccgggagtagaatgtattgaaaaatgctcaaacggtcgccgttgaacaccaggctaatctgcttcgatttcaagtcgacatacacgacttgaatccgcggtcttcaagcctggatctgcgcacaagcgttcctagaatgccatgtgaactggggagaaacttatcaggacttgccttacattctggagaccatataaatggcagcgaatccttcctgggacacaaagttgctatcaacgccaacgagaagaactgtagcatgaagcatgagacaaaatataccttttttgttctattacccacaaatgcagttgccataaattaactgaacgtccactttttttttttggattgaagaatctacttgttttctacttgaccctaagaaccccacgcacgcccatcaggaaccgcaaaaagatatcttttctggccgcagtcatggccacatcacgatgaaccagctcccgtcgcccgaccacatcctgtgcagggaatgcctccgataggtgctggaacgagtccgacaaccgcttctgtaactccggtgtgagcggccgctcgctagcagcgagtaattgctcaatgagatggccgtaagcctcttgcctggcacacacgagcgcaaggacacaggagcccgcagcgtccacaagttccatgtccaacctcttgaacaacaactgttcaaacgtcaacttcaagaattcgtccagatgaggccgtaatccagcaaccacttcggtaggattgtgcagagatgcattgcaggcgtaaatcgccatggctgtgatcgcctggaaggtcagatgagacacctcaagaatgttgtgatcaaccccaaacttgagcgacgccatcaggctgtggagcagactctcgggaagttcaacaagacgtccaggatacgactctaccagcctagagataaggcggatgtacaatgtgcagagccgcgggatctaataaaaaatacatgcacgagtgtaaagacatgtaagacatggtgtaggagtgtctccgtaggaggatgcacgctgtggtagtgagaaactcacctccagcatgttcttcttgatcagtggaatgaggatattagtgccagagaacacgactgttgacggtaggaccgcatttggcgtctggatcagcatctgatccactcctcgaacttcgagcaaacttaaaagcagttccagaaccacagagacatcaccgtagggctcatcatcggcctcctcccaggctgtcgctctctttgtgcccaagttggctgccgagaatgtctgcagcaagttcagtaggcaggtgtggaagtagctgatctgatctggcgaaagtgaactgaactccagattcttgatcaaatcggtgtaaagcctcaacaccaggacctggacctcaagaaagttgccatagacccggaccagagtgacaaaggactcaaagaacctggagctgaaattgaagatcatgggggtatttatgtcggtcagagccaacgccagtccattgaacatctaacaatgataaatggcaaaaaatcgttagccaccacgctcatctggaaactcgtataatgatggtctcagtaagcaaggagaatagcaacgtacctcgaggccgttcatgatctggctcatcacttcgttatcctgatatctagcctggaacgactgatcctgcagaacagccgcgaaccttgtctcaatggcagtcgaaatgaggccgaaatagtggccattaagttgctcagagggagcatacgagatgatggtggtgactgcctgaatcagagaactagagatgatgaaaaaggatgtccgtcagcaaaaaaaaaaaaaaaaaaaagtaaagtaactacgataagcaaatgctcttgccgccattcacgattctccggcaaccatgaacttacttgtggatgacttcgggaagtagagagagattgtcgataaagaagctgaccagagaagggaactgtgctgttcatcataagccggaaaagaacagggtaaggtgtaaggtgaagcgcttttaccgttgccatgctatcagctcgagctttactcgcattcacttaccagattgcagcaatgcatttcgaacagatgagcgttggccaaaggtattcagcaaggcaatgatctatccgtgcagaacatgtcgttgttagaggcgacggccaggcttggggcagatcatcattcaagacattaactgccagcaaaggactaacctgaaccaggacatcggggtctgcgctccacagaagaaagttggtcctcaacttgctgatcaaaaactccagaatgtcgaggccattgccgcccaccgatgcctccccatacgcctggagaagattggggcttttgagatgacggttggtgctcaagttctgttagtgaaacgattacacagaattttcatcggcatcattcctgcaacgccgtgccatgccaataagtaccttaagctggaataattgtccggggagataaataggtatgtcttgacccaacgctctagaaaccagaaaagcgacaaagctaactgcggactgcaagacgcagcctatgggagcgaaaaggaaatccaatggtgagctccagccctcgttcacctcagtccgaaaactattaatcggccgacagaaattgccttcgacgtacctggccagagtgcgggtcgagggagacggattccagaagattcatgaggttgctgaagatgtgaatgaactggtcctgctcccgcgactggctcttggagagctcattcaacgtgtctggtacatgtgctgtctctcctgtgctgttgtctgcaaagacatatccggtaatgacaatcagccagtgcaaatgctcatacaggaacgtgatgtagtcggggcggcttccatcataagtgctgttgagaaacccttgtaatccttcgatccgctcgcgaagtagaccctgcaggcgcacaaatgtattgtggggatcaagccgtgctagggcagcaatggatatcagctggtctccataggtgtcccagtcctgaaatccatcgccctcctcgtcaacctcggcgttgaacttggcgagctccaatctggtgtcaatgtacttttcaacgatgccatagctgatactgtggaagaactggagcaaactggtcgcatcagcaacgagggcgggcaggttgtgattcgagatggcggcttgcgagtcttgcactgttaacgatggtagaagaaaggcaatggcgttagttgtgctgtgtgcatgcatgccatttccacatagtcatacccacaaagtaccagtaattgcttttctcagtacctagcttgacccaagtgaccaagagctcatcgaaggcccccatgaggctttcagactcttcgggcactttggcagattcgttgagacagtggatggtcaacaaagcgacttgattgagaaagtcgaaccgctcaggcacggagcagatcgtctggatagagtggaatgatagtagctggcggatcatctcggtaatcgcaatcatgttctccgtgtattcagcttgcagacattcatccgacgagcacgacgcaacgctaaatgaaaaaaagggtcgagtttaatgccatggtgtggtgatttgaatccctcagacagaaatgctgtgtcgagaagtgaacttacttgttgatcagcgtcaaaagacccttcataactcctgagatgtgactaatggttgcctcctcgttgataaagatggctccatggagcccacaaagctgaatcagacattgccgaacgcggtgggtcatgatgttgtcttgcactagcgggaagagctacagggtccagttgtttgattgtgcattagatcggtgagcacatcagcagtctaagaaaaaagacagcggatctggctgcttgtcgtaccgtgaaaaacatggaaagcacatcggcattgacgagaactggccgccagctagcgggataaacgatggtcctgccgtagtcctcctcgtcatccgcaaaggtgccagctagtactggttgatctgattaatgtgcagaaggtatgagtctgtcagctaccgcgtgaaatgagtctactaagctgcagaacaggggcgtccttgagatgggtcgcgtcctggtacttactgctagaggaaaagtcccactgcagaatagactcgataagcatgatcgagagaccaagcagaggcttttgcgatccagtgacctcctgtccagggttgatgatcaggtcctgtagttgctcgtgtagcacattgagtgtttgctgaaagatcagctggagaagccggtcttcgaaggatgtctttgtcctgtgatgaaaatcccaggtcaaccccacgctgctggcttttcctctactcgagaactcatccacgagtgcgtgcgccagcgagagcgcgatgcgcttttcctgttcgcctagcgacagcaagtgtagaatgtggttgtaaacgacgtcttgctcctctggagaggcttccagccaaccacgcttggaaatcactgcaatagcctggtagatctgcttggccacatacgaaaccagctttgggtggtgaaggttgtagctgatcaagaagacctgtaagctctgaatctcctgcttttcataccgcgcatactcccgaacaatggcgccagtgattcctgacgcagcatggaattgaactgaggtcgagttggagtgggctgtcaaaagtgtagacaagaagcgcggtgagcccatggactcggcagcaatcacctcattccccaagccagtgcaaagaaactgcatttcgttgagtcttaccgagaaggtactggcagacaggcacaatgttctcgctctgcttgaagtcaatcagcaccttttcagcctgcacccgagtcgttggatgctacaaggccatacgatacaatgggaacaaaaagtgatcagcgctggagccttcctgtggtttgcccgagagctgtgtccctcccgctctcgtcttgacgacaggtgctgttgctgccgcggttgccgagcggacgactgctgccgcgaaggtgtgtgtgcgtgtgtgtgctggtgcaatcagtgcatggtgtgtgtgcgtgtgcgatgtgggcatatagggtacctgtgcctcagcgcatgccttctcgatggtggcgagcactgctgggtagtccatggggaggatggtcaaagttgaacagcaaaaacagacgaggcggaccttgctttgacttacaccaaccacagtcactcaagcgcgcgagagccaagcctcagatcgaactatgtctctgcatgttttgctatgaagttgaaaacacacactctactcacagtgaacaaggcacgaagacgtctatgcgtgggtgccgctgagaaggagggaaaggaggaggaggagcggtgtgtgcacaacgaaggggcagaggcgatacgcaataaacacgcgcaccctgtccgcttactgtcgtgcgacagaggcggatatgaacatcagtgtgccgggaccgtaagaggaagaggcagaaagaggggtcggggtgcacgccactcggccctgagtagacgatgtccattaacgaactcaggaacccatcttctcgaaaaccagactatgcactggcgaacgaactcctgtatacgaggatgcatctacgagtatctatatgggacgcgctgaataaaagtctaggaaacaggggcaggtgtgagcgtgagctgaaaagaattactgtacactgtcccatgtggagtcggctaattgatttgataccaaaaccatccgctagcctacttttcctggtagcgcgcaggcatcaaagcatagggcggtaggctgccgcaaaaaaaattgtgcaggcacgaaaagcactcgactgatggaagcgacacaaccgacagtaacaggacttcttctcagttgcagaagagcgcctcagagggatttcgttgctactatgacctcgcaggactttaaaacatcacggtgcactgcccctacttctccaccagagagatgtaggcgtgcaggctagagcggacagccaaacaaactttggaaatagcatacactctccacaatgctctcaaaataccactgaaaatcaacacatgtcacgagcaactttctcaacggccgtcaagttcctccaacggctggtggtaagcacaattatcaggccaccatggtgctggccaatagttgctctgtagcacaaaagcaaatgcgtgtgcatcaggcctcgccctgtcactttgctcttggactattcgtaggctcaacacacgcggcttggatgatgcgcgactccaggacatggtaaccgattagtagtagcagtagactagactagtaacgttatgttcgtccccacacaccacttttcataggcgctgaaaacggcccgcacgcacgcaccttgaacgcaataaaactgatggctcctttgattgtgatcgagagtagaatggcttacccactctgcatacatacgggatacatagaggattatggcattcgaagtggcccattctacccagtttttgcgtacgaatcattttacatatcgttctggcgctgtagacatgtacggtttttgggagggaccaatgctgtctcatcaccagagaggcactctcccctcgtcctcttcgagatggagaaacagcccacatccatgactttaggccccgtctcgctcaaccggcatttacgcatcatgcagtcttgctgagaattgatactttgaaaagatatgcatgaagtgtacggggtacccaaaccctttgagcacaaccggtaaccagtgccatcacattctgctttgcgaaccgaaggcgaactgaaactctatacaatctcggatcgaacgtttggctgtctgcgatgcaggcttcacagccgtcaacttccctgaaaactacgattttgtcgacagaaatgaatgcaacttttcattagcatcatcatcgttcatcgtcattgatacacctgtccaagtagtgtgtgtttctgcgcagactaataaatactctcacgtcgtccagaaagccccacattcatcttccaacaacagaacgattgggtgtggaaatgctctcaaaaacgggtgataccagaccgccgcaaacgatgcagcttcgtgctgagaaaaaaacagcgtaagcagtaagcactgatggcattgatctagacaaatcaccataccatataaataccgcttggcctggccactgtctttgcctctttccccttcttttatcctcccactacctcccatcatcacattgtattcaacatgcagttcaagactctcgctctcgccgccgtcgccctcgttgccgtcaacgcccagctccccgctggcggttttgacaacgatgcttgcaccacctgcaccatcggctccttcaacaaggatgcagcctgcgccgctctgcctccagcagacttggagactctcaagggcaccatcttcaaactgaacccagccaccaacaagttcagccctgacatcgctggaattgctgctcagttcgcgaagcctgagagcaagaagtgcgtctgcagctgggctgcctccccatttactgccgctggccccgccggctcgtgcatctctggcactccccccacctgcaatgccacacaggtcacaatggcctcccagggcattaccttcttgagcggcagcctttgcaagggcgcgcctgcgtccgtcgcgcctggcaccgggggtgctacctcccccgcccccgcccctaccggtgctcccgcgagcgctgccacctctttgaacattccttatgttttcaccattgccgccctcggtctcgctgccgctgttggcctgtaaagctgctgcactcgctgccttgtcgcccgtgcttgtctgaagctcctcactctcgctaatacgctcctaccatacctgtaaacaccttacttgcttgtaatataaataataaagcgtaccagtcaaagaatgtggagcggccaagcgcaattcaagtgccgcgcttgaggcatgttgatatcatacctcagaagacgttgatcctgatcttcattcagcggggcgctgttacacatcgcattgaaacattttttgcacagcgcaaatcgactgcatgtgagaaacggctcgagtgcgtgaatagtttatgaggcggacagtcgaagcattgtcgagggaggccaccgctttcttgttgacagcgaatggcaacagcagcatcgccctcgatgtgctcgcactgctatcctccgaacgatgaatcctgcggcctgtgtggtccacacgacatcaagacgcgctgcagccactcactcactcactcactcactcactcactcactcactcaatcgattgggtcacgagcgcacccactgcacatgaaggaatcaatgaatagagtttgcaggtgtggagagggccagacttgcggcaacaaaagaccggtgttgggacgtgtgtgggggatacgagcaagtggtacctacgctgctgcagcgggtcatgcccctcacacgtctctcgcccggatatttggcttgcagctcgctgcgaatccctatttcgttctctctctctcttgctctctctctctcctctctctcctctttcttcgtcccctcaccagcttctcatccacacctgcgcatcgtcctcccccgctctcattccatcgcacgcgcaccatcagaagcaccccaggcctcgtccacacatgtcccatcaacgagccaactcgacctcattcatctccaacgtctttgagtccggccacggcagagaccctgtctacgccaacaagggaggcatggctaccgtctcgggaacccccaagggcgtggacctccctgcctcctcctcgtcctcagcatcagcgccgctctctacctcccttccgcgccagcgatccttctcctcctcactctctctggccacctcgccccgaaccttcactgggtcctccattatctcgaacccaaacaatgcgtttttgaaggacgctttcgctccaatctcccccaccgtgtctgccttccctgcgggaacaggatccacatcgtcgtcgactgtcgccgcctctgcctctcaaagcgttcccgtcctccacaggagattttccagcagcttcaatcagctgaaccaaatcgtggcatcgtctcccaacaacggctcccaggtaaggcgggcattcacgcaagcatgtcgacggataaagggggatgggacgtgaatacgggggtccaagcggacaatccgggtgcatgcatgcatgggcatgaaaggaatacctgggactaaaactgctactctttcttatcctgctcttttcccgctgcatgacaatgaacctcgtatccacatttccatgacgacggttgcccacggtccgccgcctcccgcctcttgcttctcaagactattgagcgaggtcgtagaacaagcatgtttgggggcagttctccgccattgcccactggcgcatctgctcagggggcagatactagcaaaaacacatccggagccagcctcttccgaaagttttcgactactggccgttctgcaggacacccctttgacagaaatgattcaggccccaccggccttggtccgcaagtcagcggcaacaacgcggagaacgggtcattcaaagagccaaagaaacaacacccatttttcgcaaagactcctactgatgcacccgcctccagcggcggtagccacctgagtgccgtggagaagctgaagccttcacaagacaagctgtcgcgctcgagcagccccatgagaagcatgatattgaacggacagatgctggattagtggatccttttctgattgttccttctcctcacgtacgtgcacgctgctctccgcgccatgcccttctgtcgcatacggcagcgctcctttttctagtatgcaagtcggcatttagggcagaacatgccgcattcggttgcctgttcactgtccctcctttgcctctgctccacagtttatcatccctttacttatcgccctgtctgtgatttttgattcctttctttcttttcatttttgcgtgtgagtgtttgtttgtgtttcgtcagtggtgagtgagtgaggctgtgatgcagacgataacgagacaaggggcagcgggcaacaggcagcacgcgtgtacatatcaaatatcaccctgccccattgtatatagtctagtggtgctgcgggtttcgttatcgaaccatctttgctccttatcttggccacaaacgccattagatgctcaatctgcggtgtcaaagaataataaacgtttttgtcgtgcgcccatggataacaatggaccgtatctcagtgcctgaaggtgcggtaggagtaggagtgtgatgaattcccttacgcacccccaaaaaagtcaaaactactcatgtcgtgttttccctgtccaagccacacagcaagtctatcaaaaaaaggcgaataccactcactgccttgcgtcttgccatcgattcttgcttgcgtctcgagagcctgttccccatcactcttaccggccacaaccctcccatcgcaccgtccgtggacaccagccgcaccattccacggcactctcacggccgacctcaacgttttttagactttttattccagggacacgagaaagaagacgcgtcgggcgaccattgaatcccttgcgagactagagaaaatgcccgagcaaccattcgccgcatcacgtcttgcaaagtcgagggagaactacaaggcagaggaggaagctctggagcgcaaaccctcaccagtacccccagcagaaagattcttcgaaacaccggccaaggcttttaacctcgatgcgatcgagcacgagtacgacgaatttggccttgctatggaaccgacttccagcggtaagcaccagagcaaagactcgcgtcatcttgccgagataactgcaggacaaagcgaggatacatttgtctctaacaaaagtcaagattacgtttcattaggaaatatcactgacgagttgaacattcaccaggagaaggagttgacgcgaggaccaaggcgcctcactgcagggcatagggtgacatccgacggtgggtcctccacgagccctcttttcggtcaacggccagatcattcactgcaaggaaggccaacctcgagcctattttctagcacaagatctgaccatgggttgactctttccaagcccatgcgcggattcagctcagaagactttgagggtgaaacggaggaagccgacagtatggcggaggagaagatagcaaaggattcgaagtcatccagcatgccgttcatggacacatcagcccaggatgcaccgagtccagcggtggctcgtagacctcttgataaggagcgcgacgaacatgagcaagaggatcagcagcaaggggagcacgaacaagaggaccaagtgcaggaagaagtggaggagatggatcgccttcacgagcaagatcgagagaccccggggagccctttggttcacacagaaacgtcggaacagaagcaaaagccctcaggctcgttgttccccgattcccagccagacaaaggacttgtgctagccggacacgggaattacaccgaaaacgttttcgagaacgacgacgacgaagaagaggaagaaccggctcctctgccaacattatctgatctgcttgcggcgtccatgccccgcggcgagcagggcttatcaatcgcgcaggtcaaagtcgtcgtcgagtcaacagccccggagaatgtcaatgtggagcgctgggatcagctggacgaaggagactccgattctgaggaaaccgatacattcagcgctcaccgctggcaagacgcaccctcgctccattcttccgcagcacccatggaatgcagtgaggacgagtcaccgttcgcaccctttgtacgaagcacaagtcggcagccctccacacccctcgcggacgtgtctgatgcggttcagtcggatgacaatacaaaagcgggacagcccaaggatcgagacagttcggaatcggatgatgccacagaacttttgcgctcatttggcaaagttgcagcaggcgctggagcagttgctgtcggaagcaagcttctaaagtcattcctgctggaccgagactctggagatgaatcatcggccaacaatgacaccaagccatcgcagatgtatccatcgcttcctgaacagaaaccagcctaccctacgctcccaacggagcccgtgcaatcgagctcagaggacaacctaacgttagatgaaggtgcaggagtggggattgtacaaggatcacactcagtgaatgaggtcgtcgatgacgatgcatcctcggtcgcgtcaaccccacagtacactttgcttgagaaaggaaagcaggtttcacgggatgccatggaaggattggacgatcacagccacgtatggaatgacctccctcccataaccagcgttatggacagggagtacactggaggggataggacggctctcttttccatgttaagccctacaccagtgtcgccaccagctcatgccgacgagccgagaacgcgtatctatccggccgcaccgtccgcaccatggacgccggaaagcaagaactcgctttcccagcgtcggccaccagcctctgagactgtgaacgttactagcaagaacgaccccaacctcgcattcatgagttcaacacgcaaggcaccagttgcgtctcagtccccactcaaggctggagccaagtctttgctgagtgactttccagacgaacaacccaaggccgcgaacaccgctcctctgcccactatgacgctgcccgcagatccttcgaaagcaccagttttgagaggccactatgagttgccctccatcaagaaggttgaccagtggaagagcaaaaatgcgcttgcccccaacgcctttcgacgactcttcatcaatatttgcgcattgattggatccaggatagtaatgaaagcgcacttttacaggtacagaatcactttcaatcgctgcaagagttatacttgacaaagaacggtcgtcagtaactttggatctctgtacactaggtctactatcaaggtcctatcatcacttacgggacctgttgtcttttactggacaggtaatataacaagcaccgtgataaaaatgcggattgaaagaacatgccattaatatccttcgctgtgtgtagagtgggcggttattcttctcttcctactcaacattggcgaggtcttgctgagctacatgagaagctccaacaattttgagaacttgccgttgacaccctcccagagggcgctcctcggtctggacccagttgttagcaaagtgcctggcgctgtacccgttttcaagaagtccacagtcgcagtatgtcaaagatgggatgcgcttacgggattgcgggaatttatgaagtatgatcgctggcgctgcactgaattaacattgcgtgctcgcactccttgctgcagccacagaacctgtccgagagaccgagcatcaagagcacgtatgtcaaccaatctcaaggagttttcacctcgaccaggaccccgtttcagaagccacctgttggatctgtcttatcagagtacagagacgctgctacgattctgaacaaatccatgtcgcggaccttcaaccaaccaacagtgcaggataagtctgacttgagacgattgatgatgaacgtcgaggctagagaggagcttagagcggaacgcaaaacggccgataccgacccaagcaagaggccctttgctctccaaggcgcctttggcatgcagcagggcggaatggatatgtccagtcagggcgctgacagctccacgcgcccggatcttcttgccagcctcaactcgcgtggacctgttgcccgttaccagccagcactgcgcactacgctctccaaggatcacacttccaaaacggatctgcaaaaggatggactctatgttgtgggtcatggtaaggtcttgaagaacctcaagctctcggaggagcagctcgaccgatgggtatttaatttacgcaaggtaagctaccgccttttgctgcacacgactcagccattctgatcctggagcgtcaagagaggattgtaactcacatacccgagtgtgctgttttacctaatagtggatgtggaacatggtcgtcaagcctgtgtgcagcgagatggagattgtggacgaagagctggcgaaacaaggactctcttacttggactgcaagtctgctacgatgttttatactgcaggcccccctcctcaaaatgccagcgccggcccgaatggctcgaccgcggctactgcggctgcgcctgcagcagcaccgctcaacaatacccttggctggggtgccgccagcattgccaccatacgtgcaccaagcgcatttgcgtctgcagcacctcagtcgcagttacctgtttcgctgcaggatcttgaagctcgctatggagaggtagggagtttgaacattttttgtggttgctttttgctcttttgattcgttttggctttgtcgttacgactgctgtgctgtatgcagcgagctaaggctgacgattaactcctatatgcatgactagtcccgtattgtgaagcagcgaatgatcttggagcaatacttggctattcctggattcgccaaccgcaaatacgtcgtggagaggctgcgaggtaaatgctctcgactgctaccaccctgtgttggcgttctttcttgaccagccccgatctgcctatcggtcatgctctcgtctaatcatagagtgattcttttttttatttgtgggtagccatgggaccactcttgacgcactttatctgggactctcatggagtgacttgggatggtggcaagaagagctggacacccgatctgcctacggatgcgcagatcatcatgcacctgttcacggtgtacatggatctcgccatgccttcacatcccagcatgacgttggatcgctttccattctcatacaagtactatgtgcctatggaggccaagcccgacccttcgacagcgttgcaaatcaagcagactctcaagaacccccccaactacaacctggtcgtggatgggtccatgtgggaggttgttcccgtaagtgacagaagcttcttttttttatttttgttgaaggggggcgatgggtgtatgacgggtgtatgagcggttggcgctcttgtttctccacattgccactaatgcgcgcgcctgttcatattgacgttcacccttgtcttgaatagaaacgactcaatgtctggtacacgctggtgctgttcatctacatggtgatgaaggaaagcgggggttacattggccagctcaacattggcacgcagatgatgggcctgggcgatgttgtcgagggatacgatctgtagagaggatccagaagccgtgcggcgtagcaagaccccaataaaccttgcttagatatataggcgcagcgagcgacaggagagccgtttgaagttttggcgggcagcctgggcgcgcatgagtcagtctggaggcaaagcgggcgtttgtggagtggatgcgatgtgtgtaaccatccactggccgcagtcaagggggcagtgtatgcagcccgctgcataggccgtagcggccaaaagtacaaaagacatcacagccgcactgtttcctcgtttcgctcctgacctctttttcgcctctttttactattgacgtctcttcctgcctcattgcctcgctcctctcgtgctgtctcgtgctgtctctttcccttgcacgccatccccttccgccacacatacaacgctacccattcccgctctccttcccccatcccccatcgccacccgcccgcggcacgaccccttggatcgacagactctacttcaccgcaattcaccctcgcccctcttgcttagacatcatggatcaactttcagagcagctgggacagacgcggcttcaggacagtgccatccacacggatggttccggaggagttctcgaagagactgctagagctgaccagctcatccgcgagctcatcacgtgctccgagagcaagaccaagggcgcgtccaggcgtgcgcgaaacctagtccaggtcaaccgtttccagctcgacctcgatcgtgaacagcccgcggcgcaggttcgccgtgcggaggcaaatgctcgcgacaccaccacgctccttgttgcgtcttggaggatgaacgagtttgagtactccaagggcactctgccgagcttggcgcgaggattattcacataccaggatcccacagtgcctcatgcagctgcttccaagaaggacaagaaggacccgaaggaccctgtttcctcggacgagacgtcaggtcaggacaccatcgacaccaagcaaccatacccagacaacggcgggacccatcggatccttattcgcgggtacgacaagttctttaacattggtgaagtcaaaacaacaagcacagactggctgtccagtgagaccacgggtccgtacgaggtgactctcaaagagaacggatgcatcattttcatggcaggactcccgcctcatctcgttggacaggagggaggatgtgtcgtctcgagcaagcatttcttgggggagcaggctcctcttgaggaaaacgtccaaggtcccgccgtgagtcactctgcaaagggtcgggagtggctcgagaggagcttggctttcaagggaaagacgcttcaacagtttgggcgttggctttggaacaacaacttgacagcggttgcggaggtaatcgattttactggtcaaggtagcatgaatgtcacgcgaactctctgaaagccagtttctctaacgaacggttcttcactggatacatctagctgtgtgatgacagctttgaggagcacatccttgaatatccagtggagcgctcgggcctatacctccatggactgaaccgcaacacggccggatttcaaacactccctagtagtagtgtgcaagcagtcgccaaggagtggggtctcaggacgacagactacttgacgcttgactcgtaccaggacgtgatggactttgcaaataagatcaggaacactggagagtacgacaaccgggctgttgaaggctttgtggtgcggtgcaagaccaagagcgagggatcgacacactttttcaagatcaaatacgacgagccctacctgatgtaccgagagtggcgggagatcacaaaacatattctgagcgtgaccaagaaggccaagaagaccagctcaaagcaaacagatgccaagactgcgacggtggtgcctgaggagaaactgaatttgcggatgaagtacccgctgacgaagtcgtacgttgagtttgtcaaggacctgctaaagacgcagccggaattgtttgcaggatacagcaagaaccaaggcattattgcgatccgagacttgttcctcaaggcatgggagtcaaagtcttttgtggagcaggattcctctctcaagctgccggaagttgcattaaagtcgagagaggattaccagcggaccgtcatcatccccatcgcaacgatcggatgcggcaagaccacagtcagtgtcgccctctcaaagctctttgggtgggcccatgttagcagcgatgattttcaccacttccgcaagagcgcgggccagcgttttctcaaggagatcgtcaaccaactcaagaccaataccgtcgtcattgcggaccgcaacaaccatgagagcattcatagagagcggatcatgaatgaggtggtcgcagcgtttcccaagaccagatttgtggccatgttctggtctcacgatgacctacctctttccaggatcagggagctggaagtcgagcgtgttcgatccaggggcagtaatcaccagtcgctgattccagattattgcccagagtttgagagcatcatccaaaggttcctcaagaccttcgagcccttcaaccccatgggcaaaccggactctaactttagctgtgtcatcgagagcaaggtcggggaggagtctgtgacctttgtgaagaggatcgtggacgagttcgccattccggtacttggcataggcagccccggcaatgctaccgctccgtctcccgaaagcatccaggaggctgtgcggtactctatgcaggactggaaggctcctcgcgtggcgtctggcgaagccgagaagttttacaaggagaagcatggttcagagctggcccgcacgcaatccattgccgctgcttcggactctggccaggtcgttgcgaccgcagcagcaccaggaaagaaggccaaggatcccaagtactttgcgattaaggtcgagcctggtgcggtgcttcgatttctggaagaggagtttgaacaaggggataatccaaacaggcagcaaactcgacatatcacagcactcaatgaccagcagttgtggactcagtttcaacagacgatgaagagttggaaggagcagcatcgcattgggctctatcagcacgtcacgctcatccacgggagcgcccttaaggacacatcggctaagaaggcgcagcgcgcggaccagttatggaaaaagtacaaggaagagacctcatccaaggtgccgttggcctcgcaagccatgtctaatgcgtctattggctctccaacagcaactgcaccgtctttgccggaccagcacaccacggacgatgggtttgtgatggtaaccaaacgatctggcaaaagatgcaaaaccaagacgcctgctgcagcgccacctgcatccaatacgcccgggtcaggcgcgtcatcggaaggtgccgttccctccgaggaggacgatgagcttcaggcgaccattactgcggactatctcatctggacggagcgcattatgattctccgcatttcgcatgctgtcaggactaagactgggcagccctttgagaccacgcaagcgactctgcacgttacgattggtacagctggggaccatgtcaagcctttcgagtcgaatgagatccttcagaggtggacatccaagaacaagcatggcaatgaccctcggtccaaagacacgcctgctgcggagatttttgccctcaaactggacaagcccaaggtgttttcgggatatttgagggccatgactttttaatgtgcttgggacatgcatgcggctgacagacagcaagcgcattaataaaaaaagaaaaataagaaaaaaaagaactgcggaccatgcgagtacctggaattttgtagtgcattgacgccattttgccgccaaattttttcgtcgtgagccgcagcaggtaaaaaaatgagatcatactgtgcatgtttgaccaactacgtttttaaagtactatacaatagaatacaatggcggggtaaaaaagaatgctatgtgtcctcgccttctcgactttggggctattattcagctttgccaccttcctagacagttccagaggaattcataaaactttttttttctttggggttcctgtgatactcttttaaaagtgcgcggttggcaaggtcccatccattagactgggaatatctaccttttcctgcatccaagttatcgaatggtgcatacttttcctgttgtcgtggctgctgtagctgctgctgttgttgttgttgttcctgtcggttaagctctgttgggatctgtcgagacacggatgatttcatccccagccttctcgtacacaagctcctccagctgctcgatctcgaggggcttgaatcggcccaagacgtacccggcaacgacattcgatgcacgggatgccacggggggtcggccgataccgacgcgcagtcttgtgaaatgttgggtgccaaggtatttgacacatgatttgatgccattgtggccattggccgaaccctcgttcttgaacgagagctttccaatctcgcgctccatatcatcatggatgaccaggatattcgtggcaggtatccccagatctctcgctaaggtggataagaaagtggagaggtgttagcatccgtcgtgatgactgaacccccccccccaaaacggtaatgtacatttgttagtgatcatatttcggtttttccctcttacctgcacgagacacggaggagccactgatattcatgagttgcagtggtttgaggaatgtgagtttgagttccagagtcgtggtctcaactggctcggtggttttggcaagcaaggattgagacgccttgtctggggctcgagaccctgtggccagggcgggcgatggcccactcttgacatcagcagagtcgttgggaaagcgcactttgcgctgggcaggcttctttttcttcttgagggtgatcatggtggtggcagtggcgacctcggcctgccaggcgccctttttgaaccaaggggcttggaagcgctgggcgaggctgtcgacaaccatcatgccgatgttgtggcgtgtcccaggatgcgtgtagtttccgaggccaacgacctaagtgggtagttaggaaaggggaaaggggattagacactggcattcgaaaattctaggtttgtgcctgaaatgaacactccatgcaaacggcgctgcggtattttgaagggggggactgatcagtttggctatgcttaccagcatgtgcttagtagcagtagccatggggagtgggtctgttggtggctcggtgggtgggggggtgagcggatgaatggggacgagggaggggagtgtcggtgctgttttgcgccgcagacaggaggggaaatggagagagaagagagatgtgttgatccgaggaatcgaccgcggactctgatcccttttatgtgcctgcctgcctgtgtcctgcctgtgtgctcatcgcagcgcatttgccactccgcaatgcggccgcagccgcgtgtgttgacaccgccctgctcgagctatttttgcgaactgcagcacaggcgatggccttcacgccccgtaatgggcccacttccgcctcgaggactgcctttgctattcttctgcctcgttccattcgcacataacacctcgaccagcgtctttgaatccacttcaatcacatccctccgtctccctcttgtaactcccatccttcatcccccctcccctcactagccaagatgagtcaagtcattgtgatgagtatgtccgccacccgcgaggatcacccctcctgccgacacacgcacaacgcaccacatggagtgcgcgatcaaaaaacgacaatcctttttgctttcgtgcctggcagggcaaaggaacgcgtacacgacagagccacatcgctaattcaccctgcactcggctcacatcccttacctagacaccaacatggagcgcgagaccggtcgcaaggctcagacctccaacatcactgccgccaaggtgcgtacaggctatcccttttttttttttttttggcctttgcatcgaaatatttttattgtcgagatgagaaagcgacacacattcttgatcagcccgtcgtaacccttgaattccatccgctcgtcatagacggttgctgatatcatcaggacatgccttggaccccgctcgatgctcaagatgttgctggatcccatgggaggcgttgtcctgaccaacgacggaaacgctatcctgagagaggtcgaggtcgcccatcctgccgcaaagagcatgatcgagctcgccaggacacaggacgaggaagtcggcgacggaacgaccagcgtcatcatcctcggtaatcctcactcaaagatggttggatcgatctatgattaggggatcagacacccccgcaacccccctcagtctcaagcgcgttcgattctaacatgacgatgttatataccataacttttagctggcgaggttcttgctcagacgatgccttatcttgagcgcaacattcatcccattgtcatcattgccgctctcaagcaggctttggaggatgctattgagattgttgagaagatctcgatccccgtcaacgtggatgatcaaaaagagatgctggaccttgtcaagacctcgatcggcaccaagtttgtcagccgctggagtgatatgatgtgcaacctcgccttggatgccgtccgctgcgttgctgtcgaggtcgatggccgcagagaggtcgatatcaagcgttacgccagagttgagaaggtactatattgcgacatgatccaaaaccggtgctacagctaccactggacaatgtctccaactggacgacgactttgccaagatgtctaatgatgcgcatcgttttgatataatagatccccggtggcgagattgatgactcgcgcgtgttggatggagttatggtcaacaaggatgtcactcaccccaagatgcgtcgtcgcattgagaaccctcgcatcattcttctggattgccctctcgagtacaagaagggagagtctcagaccaacattgaggtgaccaaggagtctgactggagcaggattcttcagattgaggaggaacagatcaagagcatgtgcgacaagattatcgagctgaagcccgacattgtcttcacagagaagggtgtctctgacttggcgcagcactactttgtcaaggccaacatcaccgccattcgccgggtccgcaagaccgacaacaaccgtatcgcacgtgctgtcggtgccaccattgtcaaccgcgtggatgacctgaaagagtctgatgtcggaaccgactgcggattgtttgctgtggagaagattggtgacgagtaagtttttggacacgcctctggttccgactgcactgcctcatcgacaaaccttttctctctcgatactgatctatcttgtatcttctattgaatagatacttcaccttcttgaccggctgcaagaaccccaaggcttgcacgattgttcttcgtggaccttccaaggacattttgaacgaggttgagcgcaacttgatggatgccatgtgcgttgcccgcaacgtttacttcaaccccaagctggcacctggtggaggagcaacagagatggccatctctgtgggcttgatggagaagagcaagaccttggagggatcggttcagtggccttacaaggccgttgctgaggctttggaggtcattccccgcacattgatccagaactgtggaggaaatgctatcaagatcttgacggcactccgcgccaagcacgcaacgggccaccactcatggggaatcgatggacatgctggcaagattgtgaatatgcacgagtacggcatctgggagcccaacgcagtcaaggtccagaccatcaagactgccattgagtcctcgtgcctgctcctccgtgtcgatgatattgtctctggactgtctggtcagcggcctcagcagggtggtgctgcccctgagcagcaggagatgggcgagggtgacatgcagcctgagcagtaaaaaaaaaaagaaagactgtttttttgacactggatatctaatagttaggcattgcagaggcagcggatggataggaggagacgatggggaccgggaagaggcgatagttcagtttgtgggcgtcatcatgttttttttacttccaatacacagcaagaaaaatgcacctctggacgctctctcatgcatgaaggcctttttgtaaacgtatcgtgagaaaagtcgtgaacacgacatgtattgcatatgcacagaataaaattggagctattgaggctagaggattgcaaacgacgaccgagcaccgctctgaaaaatgcagtgcttagcgaccaccgcctgacttggctgctgctgcctctctcgcgtcctcctgtcggtcctcccagtccttctgcttaaaggagtcgaggattgctcgggcgtccgcaaacccttccggtgtgggcttgagaccgtaggacaacataaagttggtcttgctaccccacgactcccaaatctcgtggtcgggaatcgatcgccagccttcgtctgcagcaccctcgcgttggtttccgttgttgcgcccgctcattttgtgtgggaatgaggaaagttgagtggaaatcaagtgaaggtgcgcttgcacagcaggccacccgtgcccgagtgactcgcatcagccacccccacgcgcgccgaaaaaacagaaaactttttttggctttgacaattccgctcccattcccttccttccttccccacgccctcccccgcactcttcgcttcctccctcagcctttcaaggagtctaaagggttgcttctccagtccgcctggccttatcttcaatatcttgcaaaactgtcggaacaacaggaatctaaaagtatgtccgatgcaaagtagcacgaccccatctcggtctaccgcagaacgaaacagcacaaggagagccagccctaacgcagcactgtttctcttgccctcgcccttgtgtagtgaggaaaaccaaggtctttggaggctcttcgcacccagagttgaccggtctcattaccggccgtctcggtgtcgaacctggtgcagtcaagctgtcccagttcaagaacaaggagacctcggtcgagatcggtatggactaccgtgatgaggctacatttgaaaatcagtcagggttctcgataaggtgctcgctgaggctgaccgaccgtttatctcatcctccaactgaaaataggtgtgtctgtccgaaatgaggacgtctacattatccagtctggatcgccaaagatcaacgattccttgatggagctgttgattatgatcaacgcctgcaagggttcctcagctcagcgcatcacagctgtcattccttacttcccatactcgaagcagagcaagaagaagaagcaccgtggtgctattgctgccaaatgtaagacttgatgattgatgatggtttacctctgacgggatttgcaccatgtctaactcatcgtgctgctgtcgcctttgaattctgtttgttagtggtcgccaacatcctttccatctcaggagtcgatcacatcatcactatggacttgcatgcctcacagatgcagggcttcttcaacctccctgttgataatctctacgctgaacccactattgccaactggatccaggagaatgtggatgattggcagaacggtgtcgtcgtcagtaagaatgccggtggtgccaagaggtaacgccttggacattagctttatgcacgttgaagaaggatcaggctgaggttcgaaatgagagaccgaatgagacagaacccaacattaaccatattgctctgcttgatcctacagagttacatccctcgcagatcgcctcaacatcgactttgctttgatccacatggacaggaccaggaaaggccacgctcaggatcctgaccactccctgtcaaaacctgagaatatttataatcgcctggaggacgaggatgatgatgacgacagcatggttgacgcggagactggtcatgagattcatcgcccagaggtcgctgacgagacgtcgctgatgacccttgtcggagatgtagatggcaaagtttgcttcatcgtggtatgtatagtctggacgaatgaacatagcctacagagacagttcctcgtgccatgtcatgccacaagtcctgaagtttaccttgtttcttgacccttcaataggatgatatgattgacggatgccactcattcttggaagcggctgataacttggtgagccatggtgccaagcaggtcttcatcattgccacgcatggtattctcagcggcaactctttgcgtcagatcgaggagtgccccaacgtccacaagatcgtggtgaccaacacgtaccccattcccattgagaagcgtgcgctctgccccaagctgcgggttctcgatatcagtgccactctcgctgaggccattcgcagaacccacaatggcgagagtatcagctacttgttccagcaggtccccaagaacctgtaaagtgccccttcaactggacgatggatcagggcagaggacaccattaaggaaggaggataccaaggtcacgtaggctcatgacacaaccactcagccacacagcagtaaatcaaataagcatcagcatcattttttttaatcataagcttcgagttccatgtctcaaggttgtctttgagcgtctatcctttttttttttggaggcgcattgcagagcgttggtggcgcatgtaacaccccgcagcacggacgcctattctcctgcggaagatagagcgtgggcgtgagcactatcagtccaatgtccgatgatgaggaaaatactgtgctctttcgccgcaggaagagtcatccttacgcataggttgatctgcagatgcatgggtatcggtcgcgcgaactggccagctgctgtgcctgcaggctgcagcgatacgactgcaaatgcttataaaaaggtggcttgctgtgttgtgatatgatcagaattttttctgtatatttgtttttcgttccagggcgttccttttcgctcttttctcctcaccctccacacactctctcaacatgtctgtcggtaccatcttctcctaccccgagaaccctcgcgtcttcaaggccctcgttgtcgccaagtacaacggccttgaggtcaaggtcgatgacaagttcgtcatgggcaccaccaacaagaccgccgagtgggtcgccaagttcggctgctcccaggtccccgccttcgagggcgctgacggcaccgtcatcatcgagtctggcgccattgcctactaccgtacgtattccttgccgatgccgcaacttgattcacgccctactggattagaagagaacatatgcaccctcatggacatgggcttcatgaaggatcgagagtggcgagtgaatgatgaacttgttttaatcagttatccctgacttaatcaactgtgtcgagaacttgattactgaaaaaaacattcgccactccgatccgttacggtcgtgttcttgctctcttcctccacccccatgttcatccatcatgtatctggagactatgaggaaggagaaactgacgttatgagattttcctcattttctttatcattttgcagtcgctcacttgaaggagaactccaccctcgtcggccgctccaacgccgaggaggctcacatccagcagtgggtccagttcgtcgactgctcgatcgtccctgctttcagcacctggttgtaccccatctggggctttgctccctacaacaagctcaacgagacccaggccatcgagaaggtcaagacccagctcaagaccctcgagcaccacttgatcaagaagacctacttggttggcgagcgcgtcaccctcgctgatatcgccgttgcctcctccctctacgccggcttcaagctcgtcttcgatgccactttccgcaaggagatccccgctgtcacccgctggttcaccaccattgtcaaccagcccaacttcaaggctgttgctggtgacttcaccctctgcgaggaggccctcaagttcactccccccaagaaggagaccaaggagaagaagcccaaggaggagaagcccaaggaggagaagaagcccaaggccaaggagcccgaggccgaggccgaggagaccttcgaggatgtccccaagcccaagtccaagttggagctcttgcccgctgctaagatgccccttgacgagtggaagcgccagtactccaacaacgacacccccgtcgccatgaagtggctctgggagaacattgacctcaccgctgattactccatctggaaggtcgactacaagtacaacgacgagttgaccaagttgtacatgtccaacaacttggctggtggtctcatgaaccgtctcgagcgcgcccgcaagtacgccttcggatgcctggtcgttgctggtgaggataacgccaacatcatcaccggttacttcatcgtccgcggtaacgccgaggagatgatcgaggaggtcaccgatgctgccgactacgagtcctacaactgggtcaaggtcaccgatgtcaatgacgaggagaagaagaagattgaccaggtctttgcctgggacggttccatcgagggcaagcccatcatggatggaaaggtcttcaagtaaatgtatcgtagagcactctcgctcgaatccatacgaagcaatggggtccatcccctccgtttgtcatctaaaaaaaaccaataaacaaaaatagagctaccagcattgccttcgttgtatatatatacactcaaaacttccttgatccccacccattgcgtgaatatgaaattggtatgcacattgttatttcgctactcatcattctcactttcgttcgactcgagttcagcccttgcttccgcctcctgttttgcattttcttccgctcggacctcgctcatgacttcgtcccaggtctgatagccgtcgagatcctcgatcatcttttgtgtgatgggatccgagaacccaaagaacaaggggccactgatcctggttcctttggagtagctggcaagacatgctttggtccaggggtgagtgggtgatgatccctgaaagacctgaccactggcggattcgacaatgaagaggggcccgtcaggaccttctttgatgtgcatagtgtatcgatctcggaaatgaaatttctctgccctgtaaccgattgggtacggatgccggaagagactctatcaaagtaatagagtaagaagacacaaaccacaaaaaaaaaaaaaaaaaaagagtcaggaacagtccctcaaaaagttggtttccccccatgtcatcgcgtcggtctcttgtctcatggatcttactcccttgccgctccagtacttggccctgttctctttgcctttgtaaatcgtgcctatctcccatattgtagtcgcgatgctacctacggtgtgggatgaaatgtgaacccgtgtcagtttttctgtcctttggatgttttttcaaccattttctcacacttgtccagtcaaaaacacaaggtcttacccagcgtcaatggcgcatgggcgcaagggatgaccatctcgactgtgaagcctgtggtctgttttcttcccttccacagggactttgagtaagctcctaactgtgctggtggtgccgtgctctgtccgttcgcgtcctcacggtcgttcctgtgatgacctcctttgcctcctcctcctcctcctcctcctcctcctcctcctcctcctcctcgacccgccagttccagttgcaatccgttctcgagcgcctcgatatccacatcatatttcgtcgcgggttggcctcgtatcctcttggacgagcgtgtctgcacgggttcctgataagcaggcttcagtttccgcttgtactttcgcgtcgacatgtgagcgatgccggacgatctgttggtgggtcctgtgtattcgtcgtcgtcgtgattgaggactttggtggggtagacgtctcttggaaaagacctctggatggacacaggactgagtcctagttccagcaagagttgttggttctgcagaatgttgcggcgccgctgggtttcatagtcgacttcttctgcttctgcttctctttgctcctcctcgagttctggttctggttctgattctgacttggactcatcttccttttgccttgatgccagaggttcctttggctcgttctcatagtcggacgtgtcactcttgtcagtgtctccaccgtccgcttgctcgtcctcgccgtggaccgggataagggatggtgaatcctggatcggctttgggtcttgagcagacgtgccttgcgcaatgtcaagagaggctgtgaggtggtccatgtggtcaaaggcatcggcggctgctgcctctttgtcctgatctgcaaccgagaatgtcgaactcgctctcatcgaggctgtactgctggggacggttgctggctgttcctgaatcaggagtgaatctcgagcatgagcgctcttggtggttcgaagagaaggcatgaggcgagcctctaggcgatccatgcggtccaaggcgtccagcgctgtgagggcgatctttttctctgcaggcgagaacgttgagagctctgcagcggagaatgtctctgcgatggaagggggtggtgttcttctagcaacggctgtgggctgttcctgaatcggcaatggatctcgggcaggagtgcggtgtgctgtgtgataagagggcatgcggcggcgctctaaacggtccaggcgatccagggcctcgagcgctgcaactgcgaccgctttctctgcggctgagaacgtcgacagattggcctgtatgcgcataggggacagtgggcgtggatacaacaacgccagtacaaagtacaaagcggtacattacaacatcaaaacacaccatagagctaattttcgcagggcgagtgactggctcgagaacgggcgcgtctggaatttttttcttttttttgttcgcgcgtcggaaaggggtggcggctgtcttttccttcctttcctcgctccaccgctgcctctgcctctgcctctgcctctgcctttgcctctgcctctgcctttgcctctacctggcccctatcctttcacagctcgataaacactcccccccccctcgtcctatgtagcagcaaaatggctgtcttcactctcagagagaggaccctccctcgacaatcctcatcaacccgttctgcgaccgctaatacctactacacaaccaccgcatatggccaacctcaacacgacgtctctgcaaaagctgttgggaacaaaacaaatcttgcagttctttgcagcctcggacttttcggcctggcagtggcgatctcaacaaatactgtcttttggctacattctatcaactcgtccagagcctcggaaacaactcgcaaccttgcagccgagactgaccacgtatggcttcaagactacaagagccacatccctgctcggagcctatccggcgatgagaagtttctattgatggactacagtccttggctcggcttcaacaacatgaggtacagctctcgcacttgcagcggttacgtcaggttgtggatggcaacaacaaaacaacaaggagcatgacgacttacggttcggctttctgctggattttttcgattttttttttctttttttttttttttttctaatctcgccaccaacaggtatatgatcgaacgcgggctgtatctggcagcgctgctgaaccgcacccttgctcttcccacacatctccggatccgtcagtgttccgacgtgacgctttgtcagcagatcgccgctccactagaccccaccacgatgggacgcaacgagcaaggaagcaccatggcactcgatcttggctactttttcgatctatcgcatcttgactcaagaacccacggcagcatcattgacttccgaacgttgatggaggaggtcgtgggtatgcctaaaggcgcagctctaatcgatagccaatttggtgctcaagtgtcgcattggctgaatcaactgacgcaccaggaaaaacacaagttcgccagcgtggatgacgtggatgagatggaaacgtatgcggctctggagtatcaggacgaagagaaggcatttgatgaaatggttctcaacagccaggacagccaaccaagccttatccggagactgcggcgctcaaggtgggacttgaaggagcgagatggctactcgtatgtcgacgacctgatccgaaacgtccttgtggatgactttgaagggcccggccagactgacaaagaccatatccagttgcaaggggatgggacgttcaagatacgacgcaggttttatgcattcggggacgtccgcggcggtgggctcgacaggatagtgcagtggtctctggattttgcgcatgatccccaaagtgacaacgccgacaagggcattcctcagttggacgcggaatcttgtcgcccgcctgttgagaacccagatgtggggcagatcccatgggaggctcggttcccagcttttgcaacctgtcgcattgaaaactacgtgggtctcaagcaggaactcgcccctgttcaggaacgaatgctctcgattgaagggcagtttcacacgacaggatggatgccgttggcgttttcttcttttcaaaacgcacagacgtaccgatccaaggccatcacgtttctgcgctactcacctgcagtgtatgaggcagccgagtatctgacagccatactcgaggaaacgatccgcatgcgccaggggtggaagtggacggccagaaaaaccgacacacatggatcaccgcggttgcttctttccatgcatgtccgtcgaggcgacttcgtgacggatggatatgggtggcaggatcatggtgaagcatggctcaaaacagtcgtcaaggaagcagcggaagatgtactaggcccactctcaaagacccgtggattctatttggcgacggacgagagctcgcctagactgctggattattttcattcgctgggcgccattctctttgaggacctgatcgacgcgagattcgagcagaggtttgcaagtttacttgcagtggacgactggataggccttgtggagcaggtcatttgtgcccaagccaagatgttttatgggaccatgaccagtagctttacgagcgggatcatcaacatgaaactgaatctggaagaaggccaacacgacggcggtgaacccaactttcggtatctcatgaaaccaggcggaccctcgctcgcgcagtaaagtggatgtttcttcaaaaagtataaacaaaaggtttgatgtcccttgctttgacccatggaaattcagcctatcgcaaaaggctaccagtgtatccagtcgcaataagccgaagagctatctggaaggcttcagcaggaaaaaaaaaaaaaaaaaaaaatgcgcgagctgaacagttttacggcgaaagtagagcaaaaaatatcgcgtcaacagcaggatttgaacctgcgcgggagaacccatgagatttctagtctcacgccttaaccgctcggccatgttgactccgaaccaatcagattaattgcttgtggacgtagaattttgaaactatatgaggtattgcacaagttctacgtacaaaaccgtaaatcatatgatttacaaattggtgttcacagaattatgtacactatttttgaccgcctcaatttatatggtaggatggccgagttggtctaaggcgccgcactcaagttgcggtctcgagagaggcgtgggttcaaatcccacttctaccattttgatattgctgagtgcattcttgttttttttgcaattctgcatcctccttcagaggcagcggttttcgcatgtttgtcttgactttaacattcttttgatgatgtgagcgtacactacacttttttttttttacttgatccgacatgaggatcgaatttcaaagcacgcgttcgcgtcattataattatcgcctgcgcctcccaaacatgccacgttttttcttgttttatttccgctttgcctcattctggctcggaactacctttttctaactagcgcgcaagcgacctaaaaacgctcttttgaatcattattacaagcgtcgatacacgccaggggagtgagaagcacgactgagaaaaggtcagacgcgtaagactgaaccacatcgagtaggaaattattctatcctcaatttcgacgcgcttgctcagggtgctgaatcttatacgtcaatcgttgcaagaggtacgcgcccgctttttcatcatgtatgcaaaactaaatgtgtaccagcctaagggcccgacatcctgatggaccatggaaggctaggaccacgggtcgaggtcgcaaagatcaagtctcaatcataatgcatgaaaacattgttcagttccctccccccccccccttttttttttttcggctcgcacgcgcgattcaggaagtaattcctcggttccttgcatcttgcaaaggtaattgacggtgatcagttgacaaaatggcgaggggttttacgtgtttctttttttttgaccaagtccgtgtttttttttttgttgctgttaatgtagatttcgcgcagcatttcagatcgggggtttgtccacactgagcgtcatattcaagggcgctattaaaaaacaaatacaaaaatacacttggatatcttcttgaagtataagaagcagcctagactttctcgcgttgcctcctcgtgttgacaaaggaagagtattatcccttctgatgcttatcttccacgcgcccttctgaacgaaagacaaaaaaactaaaagaaaaagtttcataccatcaagaccttggaacttgagctgcaggccccattttttctccttgtcttttggttcaatcagacctcattctaggaaaaaatgcgccgagacgatcaactgttggggaaccttaatgcctccagggtaggctacaggaccaaagggctgtcttgcgaaatttatgcgcgatccatattcccgcaacagatggcagacgaggaaaaaaaaaaaaaaacaagtgctatgttttttgttcggatagcggtatcaaaagaaaaaagaaaaaagggatgtgtccaagaactgacaaaaaaaaaaaaaaaaacataaaggccaaaaaaccaaaacagaatttgctcttgtttactcgtggatggcctcatctcagggtctgccatctgtcgagatttttctctgtctccccgctctcttcaaacgtcgcgtttcgctcaattttttgttcgtggacacaaagataatcgaagcgacggtgctccgagcgtgctggtggagggaagagattttgggagccaataattcgttttttagtgatcgcagatgatctaataccatgaacgactcgaccccgagtttgcacacacatctcatcttccacagactgttgtataaatgctgctgtattgtttattttttgtacatcaggactctatcctatgagtgagagcatgtgccagaatgccgtttttggtatcaaacaccttggagcaaccctcctcaaaacacggatagggcggtcgagtcttcagcgtctcgtgcatccacaggtgggcgtcgagtgcgtctttgctcggtagtacacagatacatccttccaagggacactttgtctaaaatatgaagagatcgatagagtagcgatagagcgcagaaagcgagaatacacggatgaataggagaataggagattatttttgcagtttcgagaaaaaaattggcgggaggagatattaaaaaaaaagacctgttagcatttagatcgctctactgagcaacgcattgtttttgtttgttggtagaaaagaccaacgttcattggctagaaagattcacaaccgacaaaatagaaactcaccctttcctggagacaggcgtgcttgtaggctgagcgttgacattcaaacgctttctggcaggtatcataggggcataaaaagcggtaggtcgaatccagatctttgtggattctcgactgatgatccgtcaactgcttactacccgagtagttctttccacagcccctgaccagacatctccactcgaatccaagcgattgctcctcgtgcagttgcttatgtcgctggagcgtaagcgggttggccaggaccgcgttacaaccctgatggtcgcatcgaaactcctggccgatcagtcccttttcatgatccagtacatggcggcgcacataatctgtgctcccgaatgtgtaaggacagccctcaatgggacagggcagccgctcgcccgatttgacttgcttacatcgcagctcgtgcgctcgtagacatcgattcgtaccaaacaccttatcacatccctccacagggcaatacagcttcagacccgcgtcgcgctcggcatggatttgtaaatgatccttcagactcttggacgtcgccagaaccttgtcgcactcgggccagggacagtcgtgtgggcctttcttgtcggaaccagaatgcttgagctgatgctgtagaaaactcgccattgagtcacagggggcgccgcaccctggtacggggcacagatacgtctgggacgaaggcgagcgcttgttcagttttggagggacagatttactgacttttgcgccgggacgtcgacctttggcagcaccacggtcatccgtcgccgtcttgggtcggttaacaaatgcagcggtggtggctgtagtaggcggtgatttgattcgagacattggcatgtgggtgtccatgtaagcaactgcactcatggagcggggacgggaatgtggcaggacggtattactgccattgtagagcctaccatcccatcctaattgctcatcctggaacagaggcctgtcctctctgcttgtgtcaggtcgaggagccctgaaagatggcgggactcgaggtgacgagagcactgtcggtaatgactttggagaaggcgaggatgcgaacgaggcggtggaaatggacgtggttgaaagcgagggtgaggacccagatggcggcgatgctctgttcgaatccctgcgttcctcttgataatatgaacggtcaggtctcaaagagtgttgtcgctcatcgtaagagtggtgctggtgctgcggttggtggtagcgaagacgatcttcgtcgcgatggtgatgggcccgtcgctgttgcggcggtggcgggtattggaatgaatgttcatggtgcttctgcagctgcgtgtgatgctggtgtgacgcactgcacactgcgttgtccttgcccatcgagggcggaggagaacgagccatggcggaaggttctgaagcagcagagtaatgtaggccccgccgtttttgagatggatggtcctgggactcctcctcgggagatcttctgctagacattgatgccgagggaacagagtatggccgccggtcgtgaaagggttgggtattaaggtaataagtcgtgtgcgagtcgtggccttgatactgttcatacttgtgctgaatctgataacttgttcgttgagcgcagtgataataggtcgttgtggttgccatggtgtgtggttatccaaggcgtgtgacgatcccgaacgcgtcctatgtttcgagaggtgctcgaaaattctgagctgagcacaatgggctttgggataatttttggggtgctgaatgaattgtgaatgaaccaaggctgaagatggaatggaatgcaggaatgaaggagaagagagacagagaagagagagtgggagtggaggtgaaagaggaaggagggagagctggacagcaaggaggaaactaaggacagggtgaaggcgagggaaggtgaggagggctggagataaaaaaatcaagagattttcaacgagaagaagaggaaaagaaaaagacgaagtgagaaaaaaaaaaaaagtgtgcgatgcttgcttgctttgactaagcactgttgacaaggaggtggaaaaccaagcaatcttcgggcaacgaacctgcgaaggtagtaaaggctacacatgcaaaacgcgatcaccacagaggacgacaagaaaagaaaaaaaaaaccgtggcgggattaagatctgggaaaaagcacacacagcagctgctatgctctatgcactgttatgcaatgtaacattggaagtggaagctggtggccaactaacagcccatgcaaaagagtacctgaaaaatttaccaccaaggtggggggttctttagcatcttctacaatgtactgccgtgctcggttgtgttcagtagattgtcatcagagtgaatcgggggttgtgcggagtatatgagtgcctcattattgtaaagttcttggttttactgaggagatacctattctgcaaggtgggtctcgttgaatagccggccgcaatagaaacattgacatacaaaagaagacttgggcgagggcgattgaggagagtcaagtaaaatctggcttgacgacaacacagcgccaagaaaaatgcgcttgttgatgtgcaatcttccaataagacacgctaaagagcggaaaaaaatatcaaaaaagtgctgtatccttatttgtgttgtcagcagcaacctcgactcgaaaccgaggtcgaggatcaaagaagcgttagcgaggggaggggcatcaagaagttcggcaggctgaaaaaccttgcacgccgaaaacgggggtggcaagtgaaaaagcaactccaaaaattttcgcgtttatctgaattttactttacacactgtgtatgtacactattacaaacgctctaacacaaccacagcggatttcccgcccacacaccgcaccgcactagcaggcgcgcaatgcgatacataggtgtgagctggtaatgttgtgaacaaatgtgtagttccagagaggtcattggtgttgtgcttttgtgctttcaaaggagtcgagagaaaaaagggaagggaagggaagggaagggaagggtgagaagaaaaaggaaccttggcacatgtttttcatgcatccaaagaacagcacagcacggtagtctttttttctcacttttcgccgaaaactgatcagggagggagtaatgtgcgcatcatcgtcgcagagttcctctcccaaatgatcgcagtatgtttgcatagcacgctcggtcgtgagagtcgacaaggagggtgagaactgaatggaaactgaggcaggaaatatctgcgattttgccgcggaggttcgacaatgaaatgaaaagatggattcgccttcttggcgcaacgggtgtcaaagagcgaatgagcgatcggcaccacctaagatgtaattgctctcgatgtgtgcctaacacccccctctgtcgactctattgcttcatatgctctgcactctctctgaccaaacagagcgaggcgaaacgagagaggagatggtctacgagaggtgttcatcccgcgatgattttttttttctcagtgagcaaaaaggtagggtcgaaaagaatggtggtacgaacatcaacaaacatcacagcagttgggagttcaaagacagtgcgtctacctgatttcccgccggtgatacaagcctttccaaaagaaaaggcgcgcatgcaccttgcaaaagactgacccatgaacccaacaaacacaatttccggcatgacacaaacaaacagcatagcagtgcagctctccccatgaaaatagatcgttttcgacggtggaagggcgtctttgtacacacttgccttgccaacgaaaagagcgattgctgcaggtgccacgagaacgataagaggaaaaaaaatattacaccaatccacaagcaaaaagtttgatgttcttgtgaaaggcaaccacgtcgttccatgtacattttcttgtatgtactccaatctcacactcgaacctaaactcgcatagacaaacctgtatgccgccgttcttgcggacctggtgtctcgtacatgactgcatacaaccttctgaactacctttggcacatcctgtccttgtcatggcgaaggtggcacaaaaaaagaaaagtattacccttacacttccaagccgagtggatttgccgttcggctggcagtagtaccccctcctacggaggtgcattacgctgacagacggatccggaaaggggccgcttcgaacatcattatgggctatcctgccccgaactgggttcgttcctctttttgatcaaagtgaaagtgcaacctctgtgtttcgtacatggtctgagccctggacgggctttagttcacgtcgttgataaatggttttaatgatttcattgtctttgttctaccttatatatatacgtacttggtgctgttgaagtacggcgttacccacccccgcgccctcttgcgactgtgctgtatgcactgtacatcgcacgcgatatgtgacatgtacaaggaagcatcgagcgtcttcgtgcatatcttttctaacgccgactttttgtatccacgtcgggttggtagcagctgcaccctgatacacgttctaaaaaaaaaaaaaatctccctccttttcacggacacctggcaagcgcatgtagagcattcagtcccataacgccgggtagcgagatttaggatttcagcatgtgataagccaagaaggtagactattcaggcgcgagagtctaaatcagctcatgaatgtttgacagagcgactggttacaagtggcacaaagcgcctggtcacaagaggtgcagtacacatacgttggcgctcacccagaagcgccggacgccattgataacaatccttgatcataaagccttgtcagtgacggtcgtgatgatcgcggtccgtcaatctcccgcaggccaaaaaaaaaaaaaggagcataggaagaagagaaaggggagggaaggatgacaagcattgcatttgacagacaacaaaaacagcacgcgaagaatgcaatcaagggaacatgcctcaaaatctaatatatcaatgctcggatcgtctgggcgatgtacgttcgagagagctttaagttcagtgctctatgagacttaattctatcgtctcgaggtatcgccgctagcttcgtcatctcaagagtcctgtgctttagattcaggtagtgaaaaggagatctttgccgaatacagatatgtattggaggaactgctcgtacctttccttgggattacgatgagcgaatatgatggtcatttttttccgaggctacgtctagcaggtgagacaactcccctgccggctgcaaagcccagtgtgccgtaatggtgggatgcgcgacccaaggggttttaaaagacgcgtcatgaccactctgacgttgatccggcagggacgaatgaaggggtgtaaagcagcgctaagcaggcgccgtttgtcgtctccgaggcatcaatgcctctgtcgaaagtagctcacaatcacccgcgggttgtcgtggtaagatgcagaattttttttaatgctatgtgagtaaaaagcatgctcagtctggtatggcactcccttcttaaacgttcttcgcctcttccttcacctcctccttcacctccgccttcttctcactttcaaccgcatccttctcctcatcgtccttctcgttatcatcatcatcgtcatcatccagctgatccgcatagacctcagggttggctctgaagcaatcctgcatcgccttgaacttttctacacaatccactcccttgggctctgctgttgagtacacgaagcatgagaaggcttccttgaacgcatcaccgcatggaggctgagccatgcctcccaagcacggacagtcccagttgatctctcccgtctcagggttaaaggccgcagactgatccttgggatctgatgaagatgaagagctgtccttggatggtgtggtcgcttctgagggctccatgaacatgatcacgtccttcccctgttcttcttctctggtgtacgacatgtttcttgtttgtgaaatgtaagctttggtaagggtcgaaatgaggcgcaagtgggggtcgatcctgctaagagttccgtttttgaatggagaatggctgaggtagacgatctagcactgcaaaggtcagacagaagttgtttgcatatatcgtcagtttcgccgtcgccgggggtctcaagggggtcgcttttctctccggccgttttccgctatgtctctgctccattgagctttttttcgagtggtcggaacagcccgtcgtaagctgtatccggctagacaactcaagcttcagtaggctgccccgtccgcgaggggtctctggtgtctgtggtggtctccctgcttgtcactgttcataccttgaaggttgctcgaatgtcggatgtggacaaaggaatgggcggatcagggtctcttcccctgagggctccatatttacgatcgattacagcagtcactttctccgcccaactgacaaatccgacaagtcgagggttctcccgtattctctgccaagtggatcgagcgtgccctttattactgcgatcaaaaaggaaaaaaacgagcgggtatttatttcgcctcaccgcacgacctgcggctggtactgctgctgcgcttgttgctgcgagtgctgaaagtatccattgggatgcgaatgctgcatgctcgatggcagctgttgctgctgtcgtgcaaggtacttcgtgcgccagttgataaatttcttgaccgtgaactgtcgaatattggtaatctgcgtctccagcaccaactttctcaacagcggcagttcgctttcgggatgcttaaacgaaatctgatcatcgggatcgtccgaaatgggtttaggatccaccatcgacactgcaaagggaggtcctcccgtctgacccgtctcggccatatgtaccagacgatcatactcaatcctgaacgtgtagatcgacacgccctgttccttcaaggtcttcaagacagacaccttcaaatcctgaacatcctgcacagactgtgtgtcgactttggcgatgataggcaccacattggccttttccgagatcagtcgcatatactccacgtcaatgggcttgagtcggtggaggatcatatagaagcaaatgtcgataaacttgtgcgcgccaacgcctatacacatgtatgcggaataaattagcgtccgatcagcgtaccctagaccgaccaacgcttgcagcagcggggtgaggttacctgtgaccaaagacctcatcagttcgttgttactgacttccatgaatggcgagattttgctgtgcttctcctcaaaggcttgtcgaacatagctcatgaagagatcaaagttcgttcgcgcatcaatcacattgccgtagccaggcgtatctatcacgcgagagtgaaaaaaaacaaaacgacagagtggaatacagttggtgagccaaaaaaaaaagggttcatgaaacacacacacgcacgcactgtctttccttctgttatagaacttctgggcgaagtaagaaggaaaaaaaaaacgagaaaaggtttttccctcctcacaactcacccagaaagacgagattgcgcgctggcacttcatcgtctgcttccatgttatcccaggggatctccatcatcgtgctagagaacttttccgtcagcgtctctgtgcgtggatagtcatagccatcgtcgtcctcttcatcctcctgctcctccttctcttcattttccttgtcgtcgtcgtcgttgtgctccgtgccctggtccgtgtcctgatccttatgcgaggccttggtcacatccttcgcttgctttggagggttcacaggttcccagtcatgagaaaggacttcgggaagtgtcacaatgaactctcgcgcgaatgaggttttgccaacgccactgtcgcccacaacagcaaggcgaagatggccaatgttctgaccagcgaatgggttggctagtaggtaatgaggcgtggtcatcgtgctcggttagtcctggactgatatgcaatctcctgaggggaaatgtcgttgtgtgcgtgcagcgaacggagattaggtgtggaattgtcaatggtattgaacaaaaaaaaagaaacgttcggaagaaagggaggtcaggatagtgaggagcagagaggcaagaaggagagagaggacaaaggcgttgtggttgtcgtgtcgaggaaaacccacccagaagcgtcgctgacgaggactgtaccgaagccattttcgaaaggtatcaaggggggaggcgaaaaaacaaagggtaatttgatgaatgacggtgctgtagcgagtgatgggataaaaaaagaacgcaagtcgggtattttacactcttgctccagcgtgcacatgcgcccactaggcgctattcggtctagcggggagtccaaaatgctcatctagcgacatgtagtgcgctttgagccacaaaatggtcaaaaaacactcgtccttgaaaagctgaacggtgcaccaacagcagtgcaaccgtgtccaaagctcaggctctccttctgctcatctggcatagtaggccagcgtaaaaaaaaaaagaagggtggtgtttcatttgtactttgtgtgtgagaggcgcgactggtgctcgatttggtccatcacaaaggagaagctggggttactgagcatcattttcttatcgatcctgtaggtctcgttcctgggcggttgagcagcgctcgatgtttttgacagagactttgctgaagtggaggcagctgctgtaggcactggcgtcgtggccatggacgtggtccagatcatggatttctcagtctcagactttacaaacaggttggtggacaacacttgtgattgcaatgggacacctctccagctcagcttctcaatcgtcagcttcagtgcgtccgatgccgagaccttgatcgtggccggggtcttgatagaggcggacccctggacatggatttttgtcacatcatgacgaaaaagtgcgtgcaggagcacagagggtgagagagagaccactccagctataaaagggcaaaaaggcagagcgtggagagaatacatacatgcgcgatattagaaagagctgtacacaagatgtggatgataatgtgttatgttgaagggtacagtagtgttcgctttacccaacagggccaatagatgctcagtgtttccaaggaacagagtcgagggcactgcgatgcagccgcaggctccaaacacaaaggcgacgcttttacactggcgaagagaggccgcgtacggccctacataggcgagcactgaattcgagggggcaacaaaagggttcttagtctgggtttgagctgttgtcacaccaggggttgcgaagggggttcgtttccgactgtgaatggagggtgtatgcgaaatgcagcgtgcatgctgaaagctttggagctgatgctgaaagagagaaggtgatcgtctcagttgcagcaatgagaaggacatggctctttgttgtggttggtgttcagtggcgaatccagggacagcgatcccgatcccgaaggccctccgcaaccctcgcgaaaggcaaagcgtcttcttgtccctgccattttcaaatatagagggttggccagcgtaacgagaacagaaggatacattttatttgtgtagaaaaaacgagctctaaacgatgcggaccgagagtatctggccaacctctcttacgactctggccaagatgccaagcaccgctaccgagaccagtactagatccatgatcaaaagcgtgctcgcctggagcatgaacctcggcgcaaagaccttccacaccatcaggtgcctcctgaacatcccgccagtgaaaaacatattggcagcgagaaccaaggattggtgcatcatcatcatcaggcagagccttgtcagctccgggaatagcacaatcttgcccaacttgtcggccttgggcggcagcttccaaagcacaaccagtgggagcgctgcggcacagaggatgaacgggccaagtgtgttgacaatgaccagaatcggcgagaaaaagtagttgagcgtgggcacgccaacaaaggcagcagaccactgcaccgaggacagagtcgcttgatgccctgtcgcgaaaaacaagaggttgcctagcaacgaaagtaccaccgttggcagaagtaggtccaatgttggaggcttgggatgttttgccaatacggctgctgcggacgaccctgcatctgctggcgaaagttccggattctgtttggtcgtacctgaaacgccttcccggtcgacctcatctgccagtgctgccgtctcggcttggatacgttcaataacgcccctttgccaagtctcaaactgggcatcgcgccatatgtcgaccagttccaccaaacacgagatttgagctagaccgacggtgagtacgagagcacccaaaggtttctgtgtcaagattacgaacaagaatagcatcgagagtgcgacgtaatagctggctccaaaggcattggcgtatcccaaaatgtaaatcttgcgctccgtcgcaggtgcagtcgcagccttggctcctctagtcgtccttgagccagcgttgctgttgccaccactgccgtccgtgggtacatcgaccgtctggatatccatgcagagaggatttgaccaccaagcagcaggacccacgaccaacgcaaatccaaaggccacacggaccagcgtagtcttgatccagagatagtgtcctgtctgctggagcccagccttcaatggtccgaacgtattgcccgcttcctgattcctgagcacatccgcttttgatccctcaaagtcgaggaccgcgtagagagttccgagaacgataccgatccgaagtccatagtcgacccaaataagagcgatgccattcatcgactttgtcctgctgagcaaacggcggatcaggtagggcgtgatggcaccactggcaacgagagataccatcgaccactgcgatggaacagactgctgagatgaggcgtagaacgtgggtaaacacaggtctccttgctcttcgcggcacactgtcgaggaagaaatgacgcgggtcatgaccatgaaggacaggatcaaaagcacagccttattcctctcggccttattgggaacccgcagggaaaacagaagtccgatcacaccaaaggtctgcaagaatccgataataaacgtgctttcgtgaacaatgtacgagttggacgcaaagatgaggcagttgacaaagacgaagagacaggcaagaaatcctgacagtggtggccatcggatcgatctctgtaggctccagcttcctttcgtctggatcaaggttttgctctgcaagaccatgcacaataagaagcccatgatcgaaaacgccgacatgcaaaagatcatgacgtcgactaggccgatggatgagtcctggattgtctgcagcttgagcagcactggcttcagatgtctagccagcacaatacccaacagtgttcctccggccaggaaccgctctaagtgcgggggcatatccacagaccggaagatggtgatgtaaagaagcaggcacaagcagcttgcaagcaagacacctccaccagccgtcatcagtggcacgtcaaagtgcgcccagatcctcttgcatgaagtcagagaggtcctgaggtatcccgagtacaatctcacggcctcgaccaggttgtcgacattctgaaggcggcgatcctggccaatttctgccataaacctctctgcacgcttgaagaaatcgccaaattccacctgcatggcgagcgcaatgtccgagcttgggtccaggtccttgtacgactcaaagtacgtagcaacctgcgcggcgttcagtctcatcgccctcaacaggtccctcaccgcatcatctggtttcttggccgaaaggaataactctgggatcactgagccaaggttgttgtatgggatgggcaatccgagaagtagggatagggttgggaccaggtcgatctgagcaaccgtcctgtagatgtttccgccgacgggctttgtataacggagcatatcccccagcgaaaatcgatccacgataccggcattgttcagtttcctcttggaatagattaccaagccggcctcgatctcgtcatcgctgtctcctccgtgatcgccatgtccattcatgccgtggtcgcccatgatcacgaccaatgtgtcgtccgaaacgctagcaatcaccttttccagttgctcgttcataagctccagcttttgagccatgtgcgggtcattggggccataggtgtggccgcagtggtcgacgcccaaaaagtgggcgatcaaaaggtcccattttgactgatctttgagtgcaggaccgagttccttgatgacaccattatcgagcgtgtccagatcgtgtgtatcaaaagaagggaacgcgtgcgagttgttggcgatcaggatgttgggaaacaatcctgtccaggtgtcgtcgcccatgaacagtatccgatcccgacctcttgaagcctcaaactgggagagccagttgtcctccttcaaggctgacgatgcaaagttgaatccagcttcgatgatggtgggaagtgtacccgtggtcaaagccttgagtcgctgcagtgtcgttgtgggtggatcagccacgaactggtatactagggtgttttcaggctgcttctccaagaggttgtggatcacaggcagcttgttcagatagtatggctctttttcatggtcgggcagatcgttgtgtggcaccacgaaactagaaacaaagttgtaatggcagcaacaattagagtcgatgagcgatggacacgaatgttactgattgactcgcgacgaagcgaaaatcttactcaaaacgcagcgcgtcaataacgacaaccacggcctttttgtactgctgaggataccagcagttgtcctgagcttgtttcccatgcccctgccaggtgaagagggactcgtcaatgttggtgttgttgcactcgctcttggcggcaagaactgatcgtgagagcagaaatccacgcgtgaagaggtagatggcaccgacgtgcacgaggaagacccagaggaggagcttggccaatcgcgtgctcggagtgcgttccttgggcgtaagtccttttgatccggcgtcagtgtttggatgtgtggggtgtgtagggtgtgtggaccgtgatgaggcagaggcagaggcagaggcagtggcggtggagtgcatcagggtggcctgcgctgatccctgcgggtgctgtccctggaggggtgtccgtgctgccatggatgatgagtgggtcgcggggatgcgcgggctgacgatggtgatgaggatggaagtacgatgggatgaggacaggaatgcggtaggggaggaagacaagaggagtgcaaaaggccgcgagaaggacagatggggggcaaaaggagcaaatagaacagcaggaaagagaaaagctcaaaagaatatcgagaataatggagatcaaaaatcagactctcgttcgatggtcgttgggcacgcattcagcaaagcgtcctagaaaggcgtaggctcccattctttttattcttcttgccgcgcgcacgacagaaccctctgtggcttcagatccccaggacctggttctgctgcttgcgtcccatcgttggagagccgagatagggcgacgaccctcttgggaacaggctcgctaggttcgatgcagacgacgactttgctaacgacatcgaaggagagccctgagtcgacttgggcaagggctgcagatagcgcgaaaggcccggcgtggtgtgtgtaccgaccaaaacactcgaaggaatcgacttgtaatcatcctcatccgcagctgacgacggcaaagggtatgatgagtcccgtcctcggaatcccgctagcacagaaaacggatgtccattctcaagcgacggctgactttgatgtagatccactggcctatccatgtccatggccatggctgccgccatactcatccctccctcgggactggaccctcccggcattgtgtccgacgtgttggaagtcttcatacgcgtgtacagctggccatcaaaggtgtgccgttgttgatggaagctcaaggaggagctgtgctggcctgctagactaggtataggagagagtgccttctccatttgcaggccgagtccagtcgtcgatgggcttggtctatcatcatccattgaaacaactgaggtgtgctcctttttccgcttgctgctcgtgaacgatacttcacccttgcgcatcttgacatatcgctcctccgtcttttttgggagcgctgacttgagtccactctgtccatgagctgctgctgttgttccacattctgctccatcatgtccgatagtttttgatcctaaacccaggccctccagcactacacgaagcgactccttgccgtcaggaactcggttagcaaacacgacacgaatactacggtagagataaacatatccaggagccgggcagcaaaactgcaggtgaatcgcatatcgaagcgtcccgcctccattggagctaggcgtcgacggtcccttgccaggtccagtcgagtagtatttctgacgaaggaatgtcttggtgccctcgggcatgtccgtgaaatcgtatggtaccaagaacaccttgacagccgtcttgttcggattcttgatcacaacctgcacttgaccacggagtgggatgcgcatgccgcccggcattcttgcaaagcggcgcgatccccgaaagccactctccaaatccaggttgccaacatacggtagaacagggtcgtcatggaccgctggtatgctgtgtgtcaggcccaaggaagccgaagtgggaccagatccataagagctgccaaataagcctcctgaagaaaggtacgagtttgacactggtgagcttgcaaacgatcctagcggatgaggtgaaggactaacagagccatggttcccgaaagagtggctggctctaaactgaactgggtggctcgagtgggctgtatggtgttggtggtgctggctatggtgaggatgatggagcgagtgcgagtgcggatgcgactggtgagcatggtgctgtccgcctggctgatgctgaaccgaggactcatagtcgtaaaagacggccggaaactcgagctggacatgtttcggacatcttagtttcggtgggcagtccttataatcttgattggccaagacgccaatctgcgcggcgaatatcaatggcttcgaaggcagtgttgacattctgccagagaggattgactcctcatacgatccaacgagcgagccaaagagatcgccatgggaaaccgactggggtgtcaatgagcttctgcgaaggtaggagggtcgagatggagattgtcctgtaggcggtctaccaaagtgcgtctctgacgaatatgagtgtcgctgatcctgaagtgaatctcgtcgagagtaaaggctggaggtcgcacgcggcgactgctcgtcgtcaagcgagcaatctgctcgatgctcgaccactgctgtaaaatcctgactttgtgttctacttggatcgggcgagtcgtcatcacagttcatgacgatggataggcgcgaggatctcctgcgagtgataacgtgggcgagaggtgatgtcgagaacggatgatgagagtggtggtgataatgttgctgctgctggggtagcggtggactgtattgtaaagacggatgataagcacgatgaggggctggggtcgtgctagcgcccgttggtgtcttttcagtatggggttccgctgatgccaacgtggacgagggtcgtgaccgagaggtcaaagagtcccttcttggcagtgggattgagagcggcggtgagggtggaggtgggaatcggaagccgtgcggctcttcctgaatctgctgcctagcctctatgtccacatcgttcctagccagcaaagacttctgaagattctcggccgaggatcctgtctgtttcagatcctcgaccttggagggcgaaaaagctgagaacagacgatcactgctgcgtttcagtgactggagtcgggtatacgctggctcttgatgaccaggattaggcgatggcggctgcccttcaggctgacgggaggatggtgatctggagaaggacgaattgcccgggaaagcaagatttgtctccagcgtgcccacactttgtgtgtccttgcggtcagcacttgccgcagagtccagggttgaatcgttcttggcaggctgcgaggctgcgttccaagacctctgctctctctgcaaccttctcgaggcctttgctgccaggtccgagatggaggatgtgctcggctgtttgctccgatggtggcgtttcttctgagctttgagcgagtcctggaagttctctggggctatccttcctccgacggattcatcatacataccagtaacacggacacatccccaatgcatatgggaagcttcaaagttgatcactttcagagatgctgcctgaacgaattccagaggtagggtctttcgaagcgagtgtgcgaattccgtgtagggttcgtctgtggagccagagctgtgggtctcgccaatgctctgctgcccgactactggctgcgtgctgcagtaaatcgtcttgtcctgacgcggttgtgtgatatcctcgttggccgatgtgacagagtaagcgaggtcggcctttgcaagccgagtttcatcgtcaaaggaggtaaggcagttctgtagggggagagagcggatctgggtatagagcgactgcagcagcagaaccaggtctgtggtgtccctgggcgatgaggcagtcggcacagcggatggcgatgagcagctgcacttgttttgagaatggtgctggtgaagttgctttgtcttgggtgagaaatatgcactcgtgggggttttcatgcagccactatcgcacattggacgttaaaaataagtcgccagttcgctcacaaaaaaggcaatcacgcgtgcaacatagggggaccggagagatacttgtgtcatactgcaagcactgaagaaggtgtcatttcttttcccatatgcgtggatccttaccttgtctgctccgatgaggggcttgacacggctgcggatggtgtggctgcgggcgtgaacgatattacccatcgctccagcaaaacatgctgtgctgagtgaaggatgttgacatgcacaggtatgctattgcgccagatatccatatcctgcaagatcatatccagattctgctgctgttgatacatagagctggcgctgctggatatactccgtgtgggatcactctcggctcctgtcaagttgtaggagaatacaggagacgccgttctggctttaacgatgatctgcccaatcttggtgatgaactccatcactgcagagtcggggccttgctggcactgttgatggccattgctggaatgtcggccatgaggatggggggcatggctataaaggcgctgttgatgtgcaggatgttgctgtatctgggcctgctgttgtaccgatcttggatgcatatcagggctcgaagttgctgatgtgacaggaaatacaacggaaggctgcaaggcaccaaacaaagcattgggcgtcggcattgtgtctatttaatacggacgcataggatggttaagacaggggatgagatagtgtgcacttgtaccctttttttcaaccccttcctttccgaatcatgcatggcatggcatgctatatgatgacagctctcctattgcctccttgtcaagcaacacaccatacaggagatcctaatactggatgagagtggacatcacctaaacagttgcccgattcaagactgcgcttgagaggtcacttaccctgcgagtatagggggccttcgttgaagtatgtaggtatatagcctgggctggtttgagaaaaaaggtcgatgtctgccaagcaaagttctgtgcaggtgacgctcgatactgctaacacaagtccggctcttttcggctctcacaactttcacgactttgtcgctgggaaagtgccacgaatgcagaagtatctgcagctagctcggctgtccgagatcgttgttgagagcaatgcggtgacgacaaggcggggcgcaggagctgattctactaccaaacgggcagcagagggacagtcgaagaaggcgctggagtagtcaaggtcgaatgaatagaaggagcgacgggcacaaacacatgcacatgcgtctgtaggtgtggtggagtgaaggtctgctttccaactacactgcagccaatgccgctgccacggggacggagaggatctaaaaggacgtcggccaggaaatgcaaggctaggaacaggcgtgtgagcagacagggtgatcgtgaacagggtgaacagggtggaatgggtggaatgggtgaaagaaggctggaagcagaaaggcgagcaatggggcaaacaaaagaagtttttttcgtttcttttttatttgagttctggtaaaaaaaaaaaaaaagaggtcgcggacccacctgaaaacacatttttggtcccactgcatgacggttcctcctcgtcagatactaaaaacagccgcagactggagacccccgctagtctcgggctttcttagcctacgccttggccctctcaggcgatagacactggaggcgataggtcgcttgcgccaagcagaccgtagcgcgcagaagaaaccaaaaaaaaaaaggcgtgactgtctctggcgaacgctctgtccacccactcattgtacttcgcgaactatggctgttgaccgcacgcgacgcctagagaccaagtccctcaggtccttgcaacgtgcaaattcgtctccttgcactgcaaaccgccattcactcctacgcctcctattaataggcctccgttcctttttgcgtctcttcgtttccgtccacatcaggctcccatacagcacttctcacttgctggcttttcagcaggccaacgatgcacaccttgctgttttgaacattcattcactctcattgcttctacacattcctcaccctttcactctttcccgtccttccctctcccttccttcctcttatacccccgcagagcgccaccacctattctacaacccggcttcatacagacgtcgcttctcagagtgaaaaaaagacaaaccaacaagaagcttgcgctggacatacaagaatggtcctactcctttccaaacctctccgagcccagtcaggtcgcttgctcctgctggtcttcctctcactactactgatgagtgcactggtccatggacaagacacttccgactctgactctgacgagtcttcaccagagtcacccacatcaccagaggagccagagatctcctccgaaccctcagctccagtcccagtaccagcaccagcatcaacaccaacaccaacaccaccagcggcccctcaaacaccaaatctccccaaccccatcttctcaacctccgacgcctgtatcgcctgccaaaaggagtatcccttcgtcaaaggctgttctgtccatattcctgccgctgtcaacttgaccatcatcgtccagatgttgcccttctacaactgtatctgtcaggacaaactgatccacatcgacggacttcaaatgtgcagcacctgcttccggtctacgggacagcaagtgtttttgagtccacagttttacaatgtctcgaatcagcagacgaaagctctgaagaaagtgtgcagagacaccgcagatgggaccaaagtccccagtgcggcaggagcgggaaagtgggagacattagcgagatctggctgctggatggtcgtctcgctcatagtagtcatgctgcttccactcggtggtttgtagcaccaaggacccgccccccctctgacagtcttccacgaataaattaaaaaaagttgtgtggcctgcgaacgtatatctcgtccaataagattgcttgaagcttttcaaagcatgtctgtgcgaactatgaactccgattttgaggagtaacctccttgacgtttagaccgacgtatccatcttgctgtcttgacgctcccaaaccgactataattgaacaaaaaaatgtatccttgtttgagcaagacgcctaatgggcattacccaacttcctgcggatttttggatcacatacctgaacatatgccagcacgttgggaatgtcctcgggtttcatcttgtatcgccctccactgagcacggcggcttccgcgacaatcttggcgtacatttcccgaagttcaccctattgttacagcagcagaatattgggatgggaatgcgttattggttcagtgttctgctgtcaggagagtggagagtagtcacgcttgacattcagatctcggcttacattcttttcctcactgatgctggcaacaggacgattgataaagagtgtttcaatccatcgtccaagacccaagaatacgtctccgagagaacctgctctgccagacgacgcaaccagtctgaaggcttccagtaggaactcgatcgtctgctcgtgcactgaactgtcaatggctgcggctggcaaaaggaactcgttcatgatgaagttctgccacttgcgcgactgaaggaaccgaaacagctgcgtttggcgaagaagcatccccaagaatgaatggaagaaggattgataacagacatgaagtgtatcgactgttggcgagaggtagtcgtaaggcgagtttctttgcaaactggccaaaatggtgggaagtgtgcgtgtgagagcgtgaatgtcgagagtggagagcttgccgaggatataatgacacagtagctagagagagagagagagagagagagcgagagaatcataggtgtaagtacaccatgaaaacatttcctggttctttgccgatgactcttcaaagtcgttgtacctttcgagccacttcgctatcatcgagggcagccagattttcttccgtgaacttgacttcctcatactccacgttctcgtccatatcctgcttcagcattccaagagtgtcgtctaggatacaattcgtcattgtcgtcataaacttctccaagacactggcctcaactttgggaattctgaacctttgctgctgaacgatctttctagcatgtgatcccagatgaagcatagtcgcggtccaaactaaagttgaatcgctctgtgggcgatcgtggtgaaaaaaatgcagaaaatgttatcagtttgaattttcttgcggcttcatttcttgcaccttcgcccatcggcttcagctcttacgtgagcaactcttccgctctgcgtcgcgtcgtccagcaaaaccagcagtcgtgacgcaatcatgttggatgtgaatggatcgtttaagatcatggcaatatctctaagtttcaacaaagcactacctgcgttagttgcagttctaagcacacaagggccgccaacagcaacaaatgtggacatacccgtgcacaggatcatctcggttgactctgtcgaaaaatttgcgaatgttttccacgcggcgatcgtccatagacaatgtcctgttgcaagcatccaggttccacactagctcatggcatggatcaaccttggtgatctatagaatgaagacgacaggaagctttagtggccgaggtcactggggtgaaatcctgaacttttcatgtagagcttaagttgcttaccgatcccagatccgcctcgtgcatggccataaggagatcaaagcgcagcgtgcagtatatggcttcattcgtctggatgaatagtgagcgcagatgtgaaccaatgtaatcgtacagctcaattttcccgccaacaacctccagtagctgtttgatactcggatgacttcgcctacgcgtatggtaaccggaaagagggtgagagggtggccggcaacggatcccatcacagaaaggcgatctagacagaggtcttcaagaccacacaaacaagctgtacctttgggtgatgactttggcaggttgttcgatgctcatctccttggcgagacggatgatgtcggggtcagaactgtaggccttgacgatagggactatatcccttctaaacttgctgggatttgatagccatatcctgcgcttaacctccttgggcgcgatctgtacaaaggaacgtggtgtcaggaagctctgatgctcgtcctgattgcctgtcaatactagagcctctaccctctgctgtgtcctaccttgaaaagatcttcgttggcaccgatcttattgatgatatcctttgtcattttctcggggaaccgtcccagaagtgctagtgggagctcctgaagatcggcgacgtcaatatatggcaacatagattccaacgcggcgtcaactctacggaagcagaggataggctgattaatgctagtccttcgtttggtctgaaaagcttgaaatcatcctggatgcatacctggcatcgtccatcggagcagtctccagtttctgcaggagccttgactttaacgctctcatgcagcttgaatggacttcatatcttgattttccgtggtgatccagaagggggtagatcgcatctatacctggtagtaataacacgaagcgcaagcagaaacaaaaggcagaggcacaaacagagggagcagtacggagtcatacgaatctcaggcagcaacccatgcggggttctttgtgaaaaatacaggcgaagggaattgaagcagaagaacgtgaacaagaatgcattgcaagacaagcaggtggctgcggttgtgttgctatctttcaaaccgttttgctccttaatctgattaatggcatccatgggcatttgtttgccaagtatgtcgcggatcttttcgcccgcgcggggtcccagaaggcgcttttcttccattgtgtgctgttcctgtcgaaatcagtgctgaatggatgcgttttctgtgtcgagggcggagacgtgggcggaagggtcaacgacacgctctgtggaagcctctttcatctctatccaaatgctcttaagggtcgttctttgcacacgaccgtattatcagacgtctctcgcaccctacgaatcgggtgacctgcaagcggcaaaagcgaggacatgggcagcgtcagaaaaggtgcgagagcgttttgagggatgtacagtagcgtctaaaggaggccgcaaggcagaggccacttgtcaagcgcacgtcctgttgggtgagcagagcaccttttccacgcgtgctcatccattgaaatagacaaaaaggatacgctgtcatctctccgagagtgctgctggaggcccctgcttttccaaaccacagcagatgaagaggggggttgcagatggcggtgggggaccgatacgccagggcagtgcagcagcagtgcagaagcagtgcagaagcagtgcagaacagcgcatgctgggtgggtgcatgcagccaagaggggagccagagagtgtcgagtctcagacacccaaaaatatcacattcacatccagcccgagcgtgcggcagctcggtataaaaagagccgttgttgtgtcctctactcgacatccacctcgtctgcgtctctgtctttgtttccgctccttgcacttccctcgccagccgcgcatccctcgtcctcctgctgctctctggactccctcttgagtcgctcgctctctgtctctgactctctctccactctcttgactctcactctcactctctcacatttgtctgtccagtcagatccacattcattccccacaccatcactgctccttgcatcaacacaccactcgctgttgcaatcccacctgaagaacctttccattcttcgtgttgactaaaagccagaccctgcattctcccctctcgtagtctctctcagtctctctcagtctctcttagtctctctcagtctctctgagtcgtctggcctcaaggcttgctgatcgagaatcttcttgcccgagaacaaactcgctcgacctcgtatcgtacatgctggggtctgcagtaggatcgctatcgtcatcagtcgcatacccaagaggcgctctatagcccgcacaaatacccttgctttcgccgttctcgctcgtcgtgctccagcaagggccccttgtggattagaacatgtggaatcctccacccccagacatccgcgtcagcgtcaagcgtcggcccgatgtgaacaagccaaagccccagggagctggccgtccggcaaacgtgtacaatgacctctcgcccagaatcagcctcagcaacgacccaggcttccccctggagaggagtaataatccctccatcgccgacaatagtctttatcgccaagacagcgtcatgtacaacaacaacctagagaacagcaacaacaacaaccatcctgctagctcccttcccttcaatccaatttcttcgatgcaccgagcaacagctacctctggactgccgcaccctcgcctggaaaaagtcggcccgtacttggccatcgcctccttacaggcctatacggtcctaacggttgtgcgctgtcttgcagaccctgtctggatcgacgtccgtcgatcagccgagacgcctgtagcagggtcgcccatccaagccgagattggccaccttgaaaagtcgttcttggtctgtgctattgcgttcacgatgctgagctgcgtcggggtcaccctgcggatcctggacaagctgtcgtggctcaagcgcatccctgtgatcacggcatacctcgaaggtaaggttgttcctgctcccttgctcccatgttaaaaatacgctctgcattcatttcgcatttcatgggatgttgtcacaccgcaggaaatgaaattaaatttgtcgtgctccaaatacttccaaacatggccgacaatctcccccacagccatcttctgtatagccgccctgacgtccttcctcagcacgcactcgctcccgcctggcgggcagttctcgcacgggttcctgtcgtgcatcatcacggccgtcttttcgtccatcgtcgccctcatgctcaccgtcgactggtggcgcggctttccctctgccggcctgtccgccaccctcaaggcgctcatcatctcgtcctttgtcatgaccatcgtcatcatcatcggggctgccatatactcagctcttgagggctggcgctttgacgatgccgtcaacttttgcatcgtctcgtttgctaccatcggtaggggcctcatctctggtcttcattcatgctgcatgctactcctgcgcaatgccgtcaaaaagctaactcgttcacctggcacattatgatcaatcggtaggctacggcaacctaagtccccgaacagtcgcgggcagaatcatctttttcttttatggcctgctgggcatcagctctctcggattctttgttgtctcgctccgtaatgcggtcattgaacagtttcagtggcgcctggtcgatcgcttttccgctccagctcatctaacccgtgtccagacccgcatgtctgccaaagacatctcgttccccgccgcgcgatttgaggaggagcaacaggtcaaaatcatggtcaagcgcaaaatgatcctgcggatggttgccatctggatcttcatgtggttcggtggcgcgggcatcttttgtgtatttgagccgtggacgtatctggagtcgttgtatttttgtgtaagtgtccatatccgagacgattagataccatggtctcagtaaccccaaacactgacccgaatgctcgtcctcttataacacttagtttgtcaccttgacgaccatcggattcggagactatgtcccgaacgagccgggctctattgaattctggaacgtctatgtctttgtgggactctcggtctttgcctacatcctttcgctttcgtctgagtccatggcctctcagatccacctagtcgatgatcaggaagaggaggatgacgcagatatgtacggctgggagaggaatgaggatcccaacgcgccgttgacaacccgcagtgcaattttgggactagagggcttgaagtggcttcaccaccagcaacagcaacagcagcagggttcgaatgtagactttgcaccgctcgacgaagaaggaaagccaatggacattcaacagaatggcagcacgccgagctttgatggcgagggcagtttgagcggcgatcagtcgttgcagtcgtcacttcagcggtatcgttcgaaacaaaggagttctaccggtcggatactgacagtctcggccaaggagcggaaacagatgctgcaagcagagtactacgcgagtcattcgttgccgacgactatccgattcgtggatacaaaaggagtgccacatcaaaagaccattggacgaggcctgagcacgagcgacgcatactctggccttagcggtgaagctcctcgaggcgatcgacagcctgaggtatacggaactgtgggatactttggatcactgggaggtcgtgatacgaccggactgaggcgcgttggcagaaacctgaaagactctccggctctcagaggggtcggtgtggcgcatcacgggaccatgtacggagcaggatcgttgccactaagctccgctcaaactcaacagctacagcaccagccattgataagatttgactctcccaaaggaagtactaacacgacaggaggtcatcatcatgcgcaatcatcgcggagtaccagggataccaaggcgacggatcaggatagagctagatcaggatacattccttcgtgcatggacttgtttcggcagagcaagcagcaggccgattacggcgaagggccctctaatcacagtagggcttccgtacaagatcaagaattgccggttacaagggtcaggtctaacagctgggaccagtctcagagccagtatcgtgcaggaccgtcagagaacgaggtacatcgttggcttgcagagggtgcagggacattgagggcgcccgcttttaaatatggtcatatgccggatgagcagaaagtcggcgtcagctcaagctcgcacggacctcgaccgagtcagagtagcgacactaccaaggttacaagcccgcctgtaagctctttggtgtcacccgcaggatccgcgcactccgaggataaaccgaacgtatcatctttcaaaggacaggagcctgcccagcagcgtgaaggtgtcgctccagatgatgtgcaaattgtgctgactgaggaaccccaggagttgagtgcagatgatccagaggcgcctatgggtgctcgggagaccgcggtggtgaacaatgagtccatcgagtctgcttccgcccttcacggattattcagcccgaatatgtctcccctgtcgcagctgagcgagcaccatgaccatgaacgatcgtttcgtccctcgatgtcacggcccatgtctctattctcaaaccatccgcgatctggccacaatagtgctgtgcagtcccccgcatcgtccaggccttcatcaagaccaccttcggttttgatgaccatctttgacgagcccgtgacaaacctcccaggatcaaggccagcctcacgggccccgtcgctcgctgagatagcacgagtggattctagggacagctctacggctcgatggcagcctgcaccgcatatggcggggctgggaataagcggtgacggcactggggggacgggatatggtgggagagaaggtgtcaggtctagcatcagtactggacatgctctgagtccgtccttgtctgagaccagtgtcggaccctttgacgaagtcaggaaccccgaaaccatacagcgttttggcgacgatgtggacctgaacagagcggagcttcatcctcagcaagtgaatgatatgcagaggtatcgggcggacctcaggagacgggagcatgagatcgaagcccaacaagcgcactcgagcgagaggaagcgttcgtaaatatgcggctacagcctgcattgtatttttattagcatcgtccatcatttttttttctctaaagcaacttcgctgttgtttacttttctcgccagtgtgagtgtttgttctcagccaaagtctcagtcgagtctttggcgataagcgtgttcgatcctttggattgaatgcgtttgtattttgctgtctatgatttattattttttatactctacgtggaagtggtcctggcactgacgaaccttcgcgacaggaacgagagtggcgtgtaagccgtcaacgtgttcagcaaaggcgggacagaactagctaccaaggccgcgacgcggtcgtcactctcccaccaatcgaccacctgatccgccaccacatccaacttctccagatgtacggtcgccatgatccgatgtcctagccagctctggccaatatggcggactgcaccctccagccccggataatgggcctcgagcacctttccagcgcgattcaggcccgacatcctgtgaacggcctcatcctcttgcggggatggatgggatttttggatcgtcatcacagttgtccgctggcacagctcttgcgccagtgcttgctgcacaccgctaccactctcggccgggctgcagtagtagttgccgtaatccatcagagccggagcggacaggtaaggacgaggagcgcacccgaggatcgtcattccaaaagaaacggtctcgattgtctttccaagggccaaatccagcagatactcggaccacgcctggaactgttctctcgtcagatggatcatgtgaacccactgcctccacgcatcgagcgctatggaggaaaggaccggcaaggaaaccaggaccaaactcgaggcagctgcagtgggcgagaatgtgatcaacagcgtcctcttgttcgagtggcatggtggctgttgcgctttgactcgaatgtcgagcttggatctcgctgacacggatgatatggacgatgagctcgtgagagaggaaagatccgagagtttggagacgacagcaccactactcttggaaagactgagcccttcttcaagatccattcgcctccgaacgccgtctgtcagtgccctccagtcaaccttggactcgccatcgtcttgaaccaatgtctgttcggagcacaggctgcccagttccatctccatttcgagatatccatcctcgtcctcgtcttcgtcttcatccgcatcgtcgtcgtctgtgtaattcacaaatgaaggaatcggcgcaaaggaggatgaagacgaagaggaagaaccttgggatgaagacgtcagataccttgcagaagtattgaccaagggcgacgaggccatcagccattcttgctcctccacctcgggcatcgtcaagggcctcacgaccaagacaacatttccgttcgagagaaccccagtcacctcggtccatgcatacctgcaagaggcctccttgtcgtcgtcctcctcctctttgactgagctgccttgcacgcacgccatggcagcagcagcggatgggtccacccattcctcaaaacgctctccttggaattcaatggtcttgcactggcggttgtcttgtctcaagtccagactgttttcggaggccctggagcaatcgtcgtcttcaagggacggcatactctccgaggagggcgcatccgcccgccagcgggcgcgaaagaccgtacagagcgccttgcacacctgatccaaccccttgcacaaagccgacagctcttgcggatggacataggccataaccgcttcgctggccatcgcctcaatcgcaacgcgatcatgcgctaggaacacggacgtgttgacatcatcgttttcatcgtcgccactagtgttgttatcgtcatcgtcgttcatgatgcagctgctgctcaaggatgagatggcggaccagcccgtcttcctcctggcctcgcctgcggactgtgggatcgcgaacgcgtggtcgatggttccaaattgggtgacctgcaaaatcaacaagcctggatcttggatcgtcgccggttgtgttgccttgaaaggtgatgtctcgctcgaggacggactcttattgttgacggtgtgatcgctgctgtggtgccagtattcctcatccaacatgatacccgaatctcgacttctcaaaagggtcatggacgctggctttctgaccgtttgacctctattagaagactgctgcagctgcagcttctgctgttggcgcgcggtggggcattgttgaggttgagctagtcgaccgctcgcacggataccgtttcgggccgccatggccaagtcatgcatctctgtgacatcttgcacaaggtaatatcgacatcctgtagaaggagacgtggcagctctgccacggtggttatggctcggtatggaggtgggtgtggatgcggatgtggaagaagaatggtggatgcatacgtggacgcgtcgagttgtactagaaggcttcagactgggagtgacgatcgcgtcttctgaaatgagataggagtgtacagcgtctgcggtggctgtctttgaagagggcagaaggaggcacgcttcagaatcgggtaagagcacgtccgccacgtttaagcctcggagaaattgcaaggtcttggatcgagccctttggagacgatctttgtggtgtcgatcatattcgtacccagaaaggaagaggtccagtgctgcgagatcgaggtcgagaatgcgatatggagcggtatcagtagtggtgatgcagccaaaagggttgagagggcaagactctagggtatgctgttgcgtggtgttcatggcggagggaatagagggggcggacggggtatgctaggggtgctggggtatgctgggggtatgctggggcctggaagagtggagagtcggtagggtgtagaagtacgttggggggtatgtcgtaccgagcggtgtagtgatgctgtcgtggggttagatgctgcaagtgtgaggaatgacggattgagaactgatggatgcctggagcaagaggaatgccagcaatgttgaggggacggcgccaagggtccttttataatgtgtgttggtgtgccgagggttgtgaggtgtggaggaacggtgttcgaaactacgagggacttcaggggagagtgagcagacaggagacagagcactgaggtggagaggtacaaagcgctgttgaggaacaattggagtaggaagagggggaagagagataaaaggaacggccagaagagaaagagaactcggctgcacagcatccgagatgcacaaaagagaacaagaaagcaagggaccttcctctcccccttcctgcgcaatgctgcccttgccagtggaccatggcccttctaccccaacggaaaactgcagcgcaggactcaattgcccatgtacagtagcgaggcaaaggcaaggcgccgtgccactgggacgtctgctctgggagaatgctatttttttttttctttgttgttctcgcgtggcaaccgcccaaccgctgacaaaggaaagtaaactgtccaattgattgccatatgccactaccactacccactctaaggctcagttgcaaagtgtatacatcgacagagctacgcacatgcatgcgtgtacagtggtcatgatacctcaagtgtgcacaacagagaagcaactgcaaaatcatgatatatgctcttcccagccccactcacccgccccctgcttaccccagcgcacgacgagaaggcgcatcatgacatgataccctcaattccccgtacccgcgggcaaactttgtcgcatggacggaattgctctaaagcaaaggcacctctcccagagaagggtacggagcgaccagcacgcgcaaatactctataggtggcagaaagggcttctcccctgaatgtggtgtggtccctgagccgcttctcctcgaacaaaacaagaaaaatctcctcaggcacaaaaagcaatcattcatccgctggacggatccctaacaagtgattgtctctgtcgtcaaaaaacaacccatcattccacattttcatgcctccatggtccttcagcccaagtctctttagtctgcctcttgtaaggctatcattgacagtgcgggcgtgtgtacttttacagcatcttgcgattttgtcctatttcccctgcatattggatgcttgtaggacgggagattaggagatcgaaaaggtgaggtagagtacatttgacacgcaaccttttgtttttgtgcttcccgcaagcatattcagtccaatgggcgatagttttcgtgccgagtcaccaggcagccatcagctctaatggcaaatgtgtccacacagtgcagaacaacctcgagccacaatgctacactgagcgctcatcaacattgtctgcttttggcagtagggccaaatatggagatccacctagccctcatcgtctcaatgaccatggtcgaccacttgctcttgcgttttcttttatctactctggcgctgaactgccgtgttctgtcgcttttgtctcagttgctaccgaggccatggtaatggcactgagacattttttgtggccgatgggcgtagaatgctacaaaaagaaagatgtaaacaacagagagaagaggttggatggggacatcttcctatgcacgcgagacaatagaaaaatcgcatctttagctatcaccaaaagagatggtattgtaaaaggaagcaatgctggcacaatgggggatcgatgggacaaggaaaggaggtggaacacgtgttttctagtaaagcaaaggcgaaaaaaaaacgatgggggtgggggttgaggggttgaggatacaccaccttccgttgagtatcgatggcgcgcttggtcgatacattacgcgcctatggacgcgcgctgcggtgctatccatgcgaccacatcactctgaagtgggccagcgcgtgttccgtcgatgaactccactggatcgcgcaacaaaaaaaaaaaaaaaagtagcatgatgcaccgcattagccaatgccagtgtggattgccacctgctgctttccagtctcctcgtcgtcccttctttgagatcgtgggagttgagtaaccctggcgtaatcgccattggctgtgcagtttgcttttggagagatgatatgcagaatagtcagtgcgacgcggtagcacaaagactgcatgatgaagtccaaaaaccactcattgacccgcacccctcaccgcttacatttgttgagatcatgactttttcaggctgctgcacatggcgttctctctctctcctgcaagatccctgctccgacagaatacacggtcttgtctcggaggaacgttctttccttttattttccacattcgatcccacatgtaacgctcgcgccatgaagtacagtacgttccacggtctctgcagcaggaggacgtgccgttaaaaaagttcatcgtcgtttgtgcaggactgtacgcgtataaaagtacagggtccttcgtaataaggtcaagggtccatcattgggtttcctgtacctacacgaagacatgtcagtcaagctgtggaacttggacccaacgcgccacgcgttacggcggaggggatcgtgttccgtggctctcgtctgatgcagtgatgattttgttcagatgaaaatgagagccgtgggcccgctcatgagtctcactggctgtgaaacgagctacgatgtggattcgccatgcatatccgtttgcagtttgatgccgatcaatgtcttcaacgaggtggcattggagatccttatgagatgcgatgtgagtgcactttgaatccttgtgatgccagcgatgctaagtcatggtacttgtaccctgtagtaaactaccatgggcatttaccgatggccctgcagactaggctgattgatgctcttaaattgtcaccacctcagtccaaagtatagaaccaatccagccaggtctgcgcttgctggttaggtaatacatgttgtccgcctctcctcctgcgtacagtgcaggtggtccagctgctctttttatttttggtgcaacgatcaactcttgtttgtttgtgttgttgttggtttgctgcaatccccaagggccttctggaaatagacccactctcctgtagatgccttggttttgaaaggaggaaatgcccggacgatacggcagcttaaggccatgcgtttgccacgcttcccttgtcgcagttgggctgcttgctacggggttttggaagttcagagcatccaatgcacaaaagaaaagaagatgctgagctattgtgctaccaccccccgtccatcagctcagcacaaacaggagtggaaagaatctgagctctggcactgtcgaaagctcggaagttcagtcatgatggtgtaagaattagcgcttcaggctcgactagaccagaatgtcaacggtctgctccttttgagttgtgcaacggttgtatcgatttcaagtgtctccgtatcacagaaaaagtttttcgttcgtctcgatgctcacatctggagttgccaataatcgctctctctcggctgtcccccaaggccccctagccggttctgatcttcaggctcctctctcacttttatatttcgtcctcataggcgcccacccaccccactcctgtaatgcatgcagcgtcggctgtttttgtctctgcttgtttactctgtctgtttttgtccccatcttgtccgtgcctttcactaaagggccaacaaaggcaagatcggggcgccttctctcttgtctttcttctgaaccctgctccacccgccttgcatcgctcgctcgctgccccttccatctcacctccttctcgcttccttcctcttattctcccatcctcttgttcctttcacccgctttcctacacagctccagccataacgtatttcaccagcgtaattcgttgcgaagccctgctccatcagagtcccccactcttcatataacagccgatccactgcactcctgccctgccacagatctgtgcgcgcttacgcttaaatatttttcatcccgcagcccaacggtccgacctgagtgcctgcaccatccacaccctccttttcccttgcctccgcacacctcctcaggtttccttgcctcggctttgcaacccatcgtgagatcagtagctaaaaaattcaggaacacatcaaggggagcagcatacctttttatttgagtgaaatacaaccggcacctggcaacacgagccttcactcgttcgacaccttgctttacgaccccagcctgtttgacactctcaaacccttcaactagcccattcggaattagaacaaacagaaaaaaaagtcctcattcctcccaactgccaatgtcgaaaccgcatcgcgcttccacgttggggttctcctcacaaccaaaggcgcgcaccgcaggaggcatcactcgaccgtactcgtccttctcgctctacaataacaacgcggtaggatccatgcagtcgaactcacaggaccgccctcacggcctcgttcacaaaccttctgtttcgaccatactctcgagctccacctatacccattcttataccacccacccaacggccgagaacgatcttcggaagcaggtcgccaacaaggatgtcctcaaacagcaattgaagcaacagcagaagatccagcagaaaagggcactcccactcttccccacggagcgaacccgaggctcctcgtctgttcaagatgctctgcggccaggtaaggttgacgcgcacttttttttttttttttttacgagcaccaacttcaggaaacccaatttctgggtattaaaataccggaggttgaaaaaaaaaaagaatgcctcgcccattaccacgcccattccagtgcaccgcccctcctgctctagctgtcactttatctgcatcaagaccagacggctgatcgcatggatggagagagagagctcttacgttgatgcaggctcggggtgcaccctttttttttttaccgacctcgccctgtctacaaccccggatcattaaatcattgcggctgggagctgaacgcgagccaattgaccttcatttttctaacgctgcactgtctccacaccatacggcccccttgtcaatagttgatatcgagaagatcgagctaatgccgatcgagtttagccacaagatcatcatgagctgcatcgacgagatcaagctgcgcggtaaaaaaacaaaaatacctctccatatcactctcccccctcctcacttactcctcacctgctctcgtttgtgcagcacattcctctcggaaaatcgtacacatgtcgtccacaacccaaaaatcaaaaaaaggcaacaacaaacaaaaacaacaaagaaaaatagcgaaaaaagatgacatgagagccgccttttgctctcctccgagggagtagacaagacatgattggcacttgccaagagagtgagagtgatcgatacttaacaaggctggtcattaatgctgcccattgtttttttttcttcgtccttcttttggtctttaggacttaagcacaaatatctgttccgaaatgcattttatagcccgtccgttgaggctgctctgaggctagccttggaccccaccaggagtcatctcttctcagtcaagatgatgcgcatggacactgttggaggcctcctgaccactgtcctctctaggacttatccacctcttatcccgcctcacttccaggacttgtttcaaaatcccaatggcaagttgagaaggcgaaaaaaaaagcgcgtcaatggtgagacactacctcttactgatttttctgtacccgatctttcttttgttggtcttctaggacgcttcttttttgagctgctaggaatgcttccggagctcaaccggttcctctttgtcgagatcctggatctctgctgcgacttggtcgatcatcagctggacaactgtatcagccacagcaagctagccatctacccaggatcctgctgctttggactggacgagtacatgcctacgtgggacactcgatacctgatgaccaaggatctcaaaaagttctctggtgccttctaccacgtcatttacgcctaccgggaggagcgcgatctctccgcagaggagctccaacaaaaactcgacggccgagatcgtctcgtgcagcaggaacggctcctgagcctagagcaggaacatggactggagggcgcacaggccatcttgcggatggaggcaaggatcgccctgggtctatcagcagagtcgccagtggtggcacagccgcttctcggagacgacatgaaggagatctcactttatgctgataggcaggagaaggtcgtcgcggatgatgccatttcagtcctggatattcagctggaggatggaaacaccgtctctgtgatcccaaccctatacagtgtccccgaggacgcaggctcaaaagaagaggacccagagatggtgttggccgacttgaggagaagtgtctcggtcgcctctctaggatgcttttcttcctcctcctccgacaacaacaacagcagcagcagcaccacgagccgattccagtattcaggaacatccctctccgccgccaccacgaccacctctttcacgctctcaccctctgtctcatcctccaccattgcctccacatcatacgcgcgcacaatcacgcgcaaggtttccgcagcatcaccaccacttccacaggagcgcggcctgatccggacccgatcactcgcccggtttggatcgattgctcaaaacacctatccagtctctccaggagacatcttcgggatcagcagacacgcaagggaacagcgggaactacaagagttcctgctgattgcacgttcggtcaagtcacgaaaacgtcgacgcaagaacacgaccggtcaaaggatcacacaatggcagcttcacaacaagatcatccatcagcgtcatgttcagtccctgcttcactccagcaaccatcctgcactatccgccaccaaaaacctccgccgtgacaggacccgacagtttcgtaaggggatcgaggtctatcaggcgcgtgggatctcggtcgaggacgcgacaaaagagtaccaacacgatctaaagaagcaaaagcgacgcgagaaaaaggcccggcacgcagccgagcaggcccgtgccgctgccaggaaacaggcaagcctagaagccagtgcatcagcagcagcagccaagcttgaggtgagcagcagcagcagcagcatgtcaggagaccaagacgtcaccatggaagaagccgaggttctcgaggcattcgattacttgaccgatgaagagtttgagcagttcatgaccctcgccggcctcacgatgaaggatgtgaatcgcatccgcgacaaagccgcagccgtggccttgaaccaggtcaccaaggaaatccaaaccaccgcggatgcagagatcgagcgcctagcagtgtcaccacccaccctggtcaagaacgacaacagcgatgacaacgacgacgtcgcagccacccagacgtctcgcaccgctccctcgatgacagacaaaagtccatccacaccactacgcacaacattcgagtctgagatatcgcacgacgacacgattgtcatggagggcttgaaggcgagtaagaaggctcagaggcccttgagcattccgcacatgacatcaatggatttcttgctgaagcatacgaccgtgatcggagacggtaacctgcgctgctaccctgcgcagcctcctactaatgccgacgacacaaacgcgtccaccatcactgctgctgtgccccagacctcctacggcggacttttgtctcttgcagctacccccctcatggcagcagctggagacaagggcgtgaacgcagagcgcagaagtgaggagtcgaatgcctcctccaccgagaccgccgtcgaggggatcgtcacgcccctgaatggaatgaaccaccacactccaatgacgatgacgacgacgacgaccaaggcggcgccctcgttgaatcagatgcccaagctgccaataacgacagcagcagcagcagcagcagcagcaccagctgcggtggtcgttgtgatggtgcctcaagaacggatctttgagtttgaaacggtctcggacgatcaagaaagcgacgatgatctggactatttgcaggtcgatcctagcgcggatccctctatccgggtagcagacgacgatgacggctctgttgagcacaagtaccagcagcacaaggaggtggaggacgaggaagctgcagagttgagggagcttttagagtccatgactgaggaggaacggtccgagttcctgaggctgtcgcgatcagagaccttgccatccaacgtgtttttgatctcggcgtaagagcaaaaaagaagattgagagccgaagcggtctgttgacgacctttcccccccatcccccacctaccacctacccacgcattgttgtcagcacaacagaataccatttccataattgtagtattactaataacaaatagccgaaaatgaacaaggtccgggaggtataagcactccccgcagcaatccagtcgtttctcctctatcaagtttttgttgattctgaagacgagctggatcgcgccgaaatagaaaaaaaaaaagagagaaaagaaaaaaaaggaaagagagaagcggaaaaaagaaggaagtaaaaaaaaaagaagagggcaagtatttttttatatcgcaacaagcagcttggacgttcaatagtttggaaaagttggataaaggtcgacgagacattggtcttcccaggtccaatgcttgcttgttgatagagtctcgtgggcaggatttactctgacagaacctccccaccccccttagccctcttcagagaaagccatgctaatactgctggtgcataggctgctgctgttgctgagagtatggctgaggaggcatctggtgctgctgctgctgctgctgctgctgctgctgttgttgctgctgcataatctgttgctgctgcatctggacaacttggtaaggaagtggagggtgctgcggtggcataggttgttgctgctgctgctgttgctggtagacaatctgctgaggtggtggagggttggacgaaagtgggaggggctgctgttgggattgctgttggggcatcatttgtccatttgaaacgcccatctgcaccgctgcagctgcctgctgttgctgttgctgttgctgttgttgcaggttggcgtatcctcggatgtcattaaagtacacgtggttaagggcgtccttggcggtgattctcctttgaggttggtagatcaacatctgcatcagcaagtccatgccaaaggtgtcgatcatgggcacgacggtcgagagcggctttggtgggtagtaaggaaagtccttgcggtactctgacagcttggtgaccccaggccaggtctcttctgtgggtgtgcccatgaccttgaagatcttgagcagctcgtcctgattgttggatcctgcaaacagaggttttcccaagtacatttcagccatgatacagcccgcggaccaaatgtcgatcgatgttgagtaggtcttggatcctaggaggacatcgggtgctctagcagcgcgtttcgatacgtaatgaggaggccgaggtgcgttaggtctacctttcttactcagcttggaccataggggcttccaggatggcacttcttaccgataccagagcgtaacaacctcgtttgaaaaggtgttgacgggaatgccaaaagctcgagcgagtccaaagtctcccagctttagctctcctttcctgttgatcagcaagttctggggcttgaggtctctgtgcagtacccggttttcgtggcagaatgcgacgcctttgagcagctggtacataaatgccttgatgacaatgggtccaagtgctccgcggtttccatgctggtccatgtactttttcaaatcctggtccatgtactcaaagacgagcgtcagcttgttctcagtgtggatgacatcgtgcaagcggacgatgttggggtggcgaagttccttcatcaatgaaatctcgcgaatggccgttgatggtgctccctcctcagagtcgagacggatctctttcaaggcaactgcttcgccattagatcggttcttgcccttgaaaacggtcgcgtatgtgccctctccaatcttctctagactctgatagcgctccatcctgcaaagtgggggtggttttttgttggcttgtgtggtggacggtggtgcgtgggggcactgctctgttggactggctcttaggcttgggcttgcggcaatgaagcagacgcttggcaaggaagggtgcggtgcgtgaggacgtccaatgagactagtggcgacgaggatgaggcaaggcaaaggcaagggaagacaaggaagggaggaaagggggaaagggggggatgaggatggagaatgaagagaggcggacgaaaaagaagaaaaagaatatctagaagaaagaaaaaaggtccaaaaggtgaaatagaaagcagcacgcttttttgctttggtgtagggacaaaaggagacgcagcccgaccacatcgcatcccatccacttccagcaaaacaggcttggtcgttttttttttctttcttttctttactgctttccttctctcctcgcctgctcccttctcgttacttctcaccgctcccttcgctcctcgctccttgcggccacagcagcaagcgagccagccagcctgccaggcaccgcagcccaaaatgcacctgtgcgctcacgcaccgcgaccgtctctgcctgtgtcttgcatacgacccatatcatgcaggcacgctcgcccgccctccagaaacgcggggcctccaccaatgagctggcgcgtctcgcccttggtgcaacccgtatggccgttttgcagggcaagacgcacccctctcccccactcattggtcttgcacacgttctctctctcgctctctttccccctgccccaaaccgctgaggtgcacctctcagtctctccttcgcagttcactttgttgcgaccctcgctcatcactaactacaggataaacacacacaacacagactcacttgcgcttgtgctgcgtttattttctgtactcacaaaggcccaacatctcggaaaaaagaaggcaagagatatcagcaggttgacttttctttttgttcagtgcacgatcttgttcagaatcccttgcggacctcggcctgcactccatccttgacaaaatccacccacatctccatcaacccaaccttggccttgatgtgacaaacaacatccacctcaagtgatcctcccagcgccctcctcaaggcttcataccctaccgataagagatcaaacacaaccggcagctttggagtcttgcaatagcccgagtccttttgctggtgattgttggccggaatcaggatcggcttggggctcgtaaagtcatgttcaaagtcgaccaggatacgtcccagcttctcacccttgaaagatgctgtgccattaatgtaaagaacagtaatcactgtatccagtgggttctgcagctcaagctcaagcttggacgaaaatatgtacatggtggccgaaatcaaaaaatcctggtcgatctgaggtagatgagaggtgattgcaaacgaagacatcattggcttcaaaagaggaatgtgcgttgtgccagcgtaaccgagcacgctgattgttgtcgagttatcgcctatataggtggatagatagagcatcagcatgaccaagcagctcaatagacggacgtgcatcaggtttagctggagcccacggtcagagctcagcggacaacctaccagagatatacttagagataaactcccgagaggcgtttatggcaagctctgggttgcaaagcggatcgtgcttcagggcgcaatcagttgcgggatccatcatgccaatgcactcaatagtgttgtttcccggctgaagatgaacgttcgataccgaggccatgccaatcacatgcccaaggttggaccatgggaaagaaaggtctcccaatgtcgcagaaatacttgaagggttaaaaagtgtcagcgtcgctttgactgtgagcgagtgctttgtgctgtcaaccacatccaacttttctaagacaggcggcacagtcataagtcctccgaggcctaaatgtgcaggagtgatcgagctgggttagcatggctgttcagagaaaccaataaccttttcgttcaagttgttggtacaaccgttccccacctcgctgacggctgatcacgtcaaatggtatgggccctagttcaaatgttccaaggccacactcgaccaatgccgttgcctcgccaatgattccaagatcgatccactcttgcgtgaaggatgtgttcagaaaacgatagaattctggcagactgtcctcagcaacgaccagtcgagtttgttcaagatctacttccacctccagccttgtgccaacctgtcgactccttgtaggtaaaaagtccaagatttcaagcgatgttatgttcaggcctgcaggagatcgcagccacgcagcaggcttcatcttgaggagcttgatcgggaaagtgatgtttggaggcaactgtaggacactagcaaggtgaccgttcagtagagccgagtccttagcgtccgagaaaccaaaatgaagctgattcatgtccagcgattcgataaagtctttggtcggtgagcctgggaaggccatcttcaaggcaacgcctttgaaagcttctgacagccaggaaggcacttcagggtcactggagagagcacgcacacggatatccgagtcgtcccctctgatgaatcgcgacaatagctcgcccaacatcagctgcttcttggatttcgagtcgaaaaaggcacccttgccactatcttgcgtccagtcgtcaagatggaagaggcgacctgaaagcatgatctcatttgattgcccagcagcgaggtttaggtccgtacatttgacctctgcaatctgatattggtccgcgtcagggtcagtcttggaagggaggaagattccgaacgagatgggtcccatcttgagtgagacgactttggaaggattgtcgattcttgcaacggccgacatggctattccgcctctaggatcctcgtccggcagagccatcgaggctaaggtcgcatcctgaatccccttcaatccatccaaggcaacttttagattcagacgaagcttcataaaccacagcgagccaagtcttgtggatacaggacctcgaacagccagatcgacggttggctgttgaagggtactttgaaaaaactcggccataagtgtcgcgttggtcacgaggacgtgtgttgagatgtctagccgcaagatacctccaaggggcatttgttgctcctcgacctggaactgtgccatctcaagcttctcgtctgcagtgggcaaactcagactcagtattgttggctgtatagtcatggtgggtcgaaacaccttctgaatgatggccgtcagtccaaagaatccgtcgttatcggcgtcgagttgtattgtgctttgaatcgccacctggaaacccgtttcatcagtttcgctaatgtccgtcctctggatctcgagtactaaggcgcgatcaaggacccgttgagctaccagtggggagatgatcaagatcaggaggcaaacggccaagagcaatccgacaatcttgatagtgcgagggtaggtcttgttccaaagcttgaggcgctctttgagcgagagcagcttgccagtcagcgagccacggccttgctgtcgtccacgttcacgtctacgatcttgttcgccggcagcagtatcgtcatatgttcctgatgcatcagcgggtatacccaggctcgtgctcatgtccccacccacatgatcgttgctgttgctgctcttgtagtttggctcagagcggagcctgcttgtgttgcctacagatcgctgcgtatcctctgaggtgtgcgtgagcagaggtgtttgctcgcccgctgtgtcgtcggtgtcgacagcgtagcgagtgccgctgctgttgccattaccgccactcctgccgtggtcggcaaggttcatgctgcttgcggggtgggtggtgactgtcctcttgggctgagaattgaccaagctcgcttcaacgctgctgtcgctcagattattcatgtactgaatcgctctgatcgcattcgcaagacaaaggatgcctgtcggtcagcgcaacgggaaaagcaagaaaagatcaaggggaagcagaacggggacttttgaagagtgaaagagtgtaagaatgaaagagacaaagaactaatggataaaaacgagagagggactcaaattcatatctatccgcagaaaatcctttattctggggaaatatccaccataaaccgcaaacgacaacatcccctcctgactgacagcatgaacgcagggcatggatcgtgcgtgtgagtcatgcagcaccagcgcatttgcttagtctcccggccagaccctcatttgagtggaagtaggacagctgtccgtcagggtaaggaacaaaatggccttgcggatgattttaggataggggaataaagtgggtcgagcgaaaaagtcattcctccttgtgttcgggtggatttgtcggagacgctcctgaagcagctacagcaacgatggctttattattggcgatggagagtttaccggctatttttccattaccaggacaggcggacagaaccttctgaatattaacgacgcaagcggtaatggcagtgccggccggggatgtcttcagatcgatacggcgtcgaagaagagaactgtgtggaattaatactgtaggtcagaaggagtgcaaaggctgacgcgtcaattgtggccctctttgagtccaacccacggtctggccgcgagactagcattcgctcatcgttccataggggctgcaagcagcgtatgcacaaacaaagtttcagcagcctcggtagatcccccctctcaatacaaaaggcactgctaggcttgtgctctcgctacaccccatcagcagagcaccagcagagcaccagcagactgacagagtgagtgagagtgaataacagatggtttagggcatatcgggcgagcaagagaaggcgcgtgtttccatgagcgcagggccacgaacagttactgtaggttgccaccacatcaaccttactactatgtttgccaccagcccagcccgcgctcttcagtaggtttattgaagtctattgcgctttttcccctgtccggcacctctttgctttgcctccgcccactgctcctcattcataatctcttccactcccgccatcacttcacagttgctcatctacgacatccactgacaactctgcacactcataagttcctatacttccgccgtcagtccagaaaggtataaaaagccttaagcgaggaggcgagagagcgaatcgcactttagtcagttgcgcaaaataccgatccgccttggctcagcacaggagattggggtccgaatcagagtgacgcagcaaccctccgcggctgtttgcttgtcgctgctcagcagttgcgatgacaggatctcaaacacatgcgcactctgaatgcgtattgctagcttgccaagcacatttctgagagcacgtcagcgctgtcgacactgtcaccgaaaagcccttgtgaatctccgttatcgagtttttcttcgctctggatgcatgtgggtgcctgagggccaaggtggttgggcagagtgggcgagcaaaaaaagaaaaaaaaaaggtttccctcagaaaacccccccgtgaccatttatcgctgtcggatgggtcacagctctttgaggccgatgactggctgactgggctgactgactgactgacaccaccaccgtagcacaaccgttgctgctgcttgactcctttgttcaagaagtcctccattcattcactcacactctctttgtctcttctccaatcccgtctgtgcccatcgctccttgtcccgccccgtcaccttcctccgctggttcccgtgctcgttgcgttgtctgggccaggcctctcagcagtgactcctcgcggtacgagcgactccctcgctgcacacgcacacacaccgtcctcgctccttgtctctgctgcagcgcaggaccagctgaccacaaatcatgctgtgcctctcaccagacgggaccaacgggatctacggcgcaagcacccaaccagcagctgcctataaatccttggcatccgccccccgatccagcggctgcctttgtccagccccatcgtcctctctgccaggcacccgcacccacactcttgcaggtccgcctcgctcccccatggctcctctctcataccaccatcctgccctcacagcactcgagtccttctccgcatcctccacagcaacaccatgcgactctgcgtcctatgaccagccaccctcctggagccacccagcgggcagtgtcctgccagtgcctctgctcctcaacccaacagtagcggacaaggccatcatggtggcccaccttatcggtaagagctactgtggagactttgatctgttgcgtctatacatctagaccgcaagattagaccagccgatattggaggagcatctgaggatccatctcgtctgacctttcatctgtcggctctctccccctctgattcatttttgtctcgttctaggcaaggccgctcagatcatcgagtctgtttggcccagttcgcaccagtccctccactactcatccaagacccctgtcatgccccttcacgtctttgtcaaggaaacactcaggagatcccgcacgaccctttccacactccagctagcgcttttctacatttacaaagtcaaggctcccgtcctcgctgcccaacggcgtcaggatgtgagccaaagagcacttcagccgagattgccaccttcgcctagcttttcatgcgatgagcggtccgatcccgggtacatgccacatgagtactttgcgtttacacagcctagtctctcgcggagcagtcttccgccgacgccaccctacgcctgcaatacgccctctttgtcgccgttatcgcaggccaccacagcgatgagcgcgcctgctgccgagaacgccaaacatgttgggtgtggccgccgcatgtttcttgccgccctgatcctcgcttccaagtaccagcaagaccgctcgtactccaacaaggcctggtccaagatctctggcttgcctgttgccgagatcaaccgaaacgaaatcgcattcctggcgttgatcgaataccgcctttttgtttcgccgtcagtcttccaaaagtgggtcgtcgtcctgacggataaaacatatgttgcagagaggccagcactgtctcgcagtaatagcacgcccaggatgggttctggcgctcttgcaaatcgccgttacgccctgagacgcaactctgctcagtacgaccacctgggcgatgtgggcggtaatggtctttgtccctcagctctgccatcgtatgtcgctctctccgccttggatatgcccactgagctacctgcgtctgtcgctcctccccgtttgattcatgagcagcgagacgtgggatcgtacatgacccagcagtgggtcgaggcccagaggcgcgagctcttccagactcgttcttatgtcccctccgtccatacgtcgtcggtattatccagagccacggttgtaggcaaaatggatcctttatggggagacagccgcgctgagatgacgcaaggtaggggatgtggcgtgctgccatcgcccacctcttcgctttcgtcgaccggtgataggcactgcaccaagcgtcgtgctgaggttgagattgctcctactgaggtcaagactcgccgcctcagtgtttcgttccttgtcgacccatagctcttgcttcttaaagactatttgccttggcactttcactctctctactctcttttccattccgcccccctgtaccaagttgctgccatcatagagcatgtagtgtatatgtaatgcggtgttatttgtagcccactagggcctgtaccattagaacaaagcgcttgtcaactattcgtcgtccgtttgctgtttgtccgtagattagttgtgtgccttgaggaacgggatcggacaccgatcagcacgtgaaatcgcggatgtgattggcccaggtacgatcgattccattcaccagcctacagaagtaccgagtgaccgttggttgcttgtcgcttcactccgtcgtcccattcgtgcccactgcaccactttttgcactactttgcaccgcagccattggccttctcgtcttcatcttcttcttcttcttcttctcgacacctcagcatcagcacgcggccaccagaaccaaccatcacccactcgtccccgcccctttcgcagcctaccttcgctccctgacacccgcaccctcttcgcccgccctccacgatgattcgtgccggtccctcggtccccattccccgcaccgtgcccttgctgcccctcccagacaaggtcctgctgcccggcgtcgtcacccgcctgcagatcacccgccgcgactcgctccccttgttcgaaaagatcctgcgctcctacgacagcagggagctcagtaaatgcatcattggcgtctttcctcttcgcatcccccaggattcagcctccgcccctagtagtccctccacgacgacgacgccattgtccagcccgaatggcacgagtgacacaagaggcaagcctctgggcgacctcatcatccctgggccctcacccgtctaccctggaggtgggtcgagcgagggccagctcgtgacgagaatgacgaacagtggtcggtccggcaccaggaacgaggtcaacccagcccatattcactcgacaggctgcgcggctcggctagtccgcctagagcgtgcggtgggaggatttacagttgtgctggaaggtaacaaaacatcgcccttttgtgtgatttttttttccttcttggtttcgttatccctagtacgtttcctataaactgaccctactgcattacgatggatgacacttaaaacaggacttgtcagactgcgattgaacaggatcttgtcccagtcaccgtttttggaagcggacgtgacacccttgccggacaaggccgtcgacaagacggaccaggagcttcaggatcagatcgtgactcttcggtccatctcacgcgagtttgtctcgttgcttcagacgctcaagctgcctgcacccgtgctgacccagttgcaaaagttcctggacaatgtggcactgatgcctgggcaggtcgtggatctgctcatgagcacgatcgaaagcactgtggaggagaaaatcaccatcctggacgctgtcgatctcaaggacaggatccacaaggcggtcgaactcttgaccaggcagattcatgtacgggggaaaaaaaagtcgtatcgcgtgtccttatgctgtcttctattccccccctcccccccccttgcggtagatattaacgtgctatcctcgacgcgattgctttacgtaggtgttgaagatctcgcaaaaggttcacgacaatgtcgaaggaaagctcaacaagaaacagcgagagttctacctccgtcaacagatggctgccatcaaagaggagctcggagaaaaggatgctggcgaggaagatgagatgagcgtgattgaacaacgactgacggctgccaatctgcctccagaagtccaaaaggcggctgaccgggaactgaagcgactccgcaagatgcaaccgtcctcgtccgagtactcggtcattcgcaattacctcgactggctcgcggacttgccctgggccgtttcgagcgaggatgtgttggacgtggaaaaggcgaggcggcagctgaatgatgatcatcatggactagaaaaggtcaagcggaggattctcgagtatttggccgtcaccaagctgcagcaactcaagggcgacgtcaagggtcccatcctctgtctcgttggaccgccaggtgtaagtttgtatcaccttgcttcccgttcatcgcttgtgaccatagtgaaagggcgaacagatcactaatcgttggggtttgatgaataggttggtaaaacgtcgctgggccgttcgatcgcagcagccatgggccgcaagttccatcggatctcgttaggaggtgtttgggacgagtccgagattcgaggccatcgtcgaacctatgtcggagccctccccggccttatcatccacggtctcaagaagtgtgaagtcaacaaccccgtattcttgcttggtaagtagttcatgctgacaaagaattatttttttttgttttcactcggctctttgacatgaggcattgctgcagtactagccaacgaaactcatgcgactcctcttttgttgtgtactgtccatattagatgagattgacaaggtgggatccagaggacatcacggcgatccgtccgctgcattccttgaagtcttggatcctgaacagaacagcacctttgtaagtagatcaagcgaagctgtgactctggtcgtgtcagtaccggcacgggatggatgtagttagactaactatcctttcaattcgactcttttccacagacggaccactatctcaatgtacccttcgacctttccaaggtcctgtttattgccactgccaactcattggagaccattccaggacctctgctggacagaatggaaaccatcacgatccccggatatacctatgctgagaagctcgccatcgccaccaaccatctcttgccgaaacaaattcgacagcatggactgggcgagacggatgtgcaggtgactcaggatgcgctgctcaaggtggcgactggttacacacgcgagagcggcgtccgccatctggagcgtgagattggatcgctggtccgtgccaaggcagtcgagtatgcagaggcgcaggagaagaggctctctcggtcgacggaggagacgagtgcctctcctgttgaataccaaccgctggtcaccttggcggacgtggaagacattctggggcaggaaaagtttgtgaatgaggtcacggagcggatacctgttccgggagtggtgacgggcatggcctacaacggcgttgggggcggcatcctgttcattgaggtctcccagatgcctggcaagggccacctgcagctgacgggcagcctgggcgatgtcatcaaggagagtgcccagatcgcgttgagctgggtcaagagccatggatacgacattgggttgaccaacagccccggtcagaacgtgatggagaaggcagatgttcatattcacatgcccagtggtggcacacccaaggtaaagaatgaaaagcgaaggaggcggggacgtacacatcaggtttcaaaaaagctgatggttgacagaaacgattcagaaccccgctaactgtcgtctattcgacgattgatgctcgtctccataggatggaccgtcggctggtattgccatggtatgtgcgttggtgtccatgttctcgaaccagaccgtgcccagcacgacggcgatgacgggcgagtttacgctgcgcggtctggtcatgcccgtgggaggcatcaaggaaaaggtgattgccgcgcaccgggcaggcgttcgcaagatcatcatgcccctccgaaatcaaaaggacgtgacctcggacgtgccggccaacgtccgtgaggacattgagttctattacgcgtcaacggtctgggaagtgctccgggaggcctttgagggaaggctgatggttcgctctgcgggcagcagcgctagtgtcgtcgacagtcgtttgtagatcaatagactcttttcagtaaaaaaaaaaaaaaaagctttgcccacccacccacagcttggccctgttcccacacgatatctttcattctttttttttttcttatttttttttgctgacaaagcaactcgtccttactactgcttgactttgctaaagatggtgggggtgcgcgaggcatcgatcgcgtccttgtccttgaacttttccttgatctggtccatgacctccttgatactcgaccggtccagatcatctctccgtcccagaatatcctccaccagcgggatgggcaggtcgtgatagatgcgcttggtggcataaaagttgaggtaggccgtcttcttggtactgcacataaacttgtgcagctgctcgatcgcatcaaagtcctgctccaaatcgcccaccgacttgtaatgcacaaaaaagttgaacacgaccgctcgatcttgctgcaatcgatccgtgcagaccggaaacttgagcttcacgcccttgttgcggagtgagtcaatctgcgcaataaacagacgttccagcatccaatccaccagcttgttgaacatgtagtcgttcagatgcaccttaaagtcatcgttgtagtccttgagcgtcgcaacaatcagcgccatcggatcatcctcgtaccacgagctcgtgtgcagtttgctgaacggctccttgacgtcgttgaaggccaggtccaagagcgagttggcgccgtgggtcgccacttcgaaaaagtcatccatcgtctcgttcaggagcctcttgaccttctcgaaattctcgggttccttgatcagccgctcactctccagcctctgcaacaccgcatccgcaaactcggcacacttgatctgatcgttcgtcgccgccatgatgtactcggccagtccgggcggtgtcgtgctcggggactcgatctgcttcttcatctcggaggtgatcagcgccttccatttctgctggtagtccttgatgacctccacacactccttgatgacctgctccatcacattgctctgttgagaatccgaggccaggctgacctgctgattgaccatctcaaacaaaatgttggccgtctgcatgtggtataacttgtccgcgtccttctcgggcgcagactgacgctccgtaaactctgtcgtcgcagtgttcatcatgttggtagtccacttgatgaggttctttcggaccaacttcaggtactcatccagcagtccttgctcgttcccgtccagcagctggggctccagcaactcctcagtcacacccagttggtggttcatgttggcataatactccctcacccagcgcagcaggtgcaggatgcgaccgccatccaagtctggagagctgacgatcttgttggccaactcgtacacgtggcggtggtactccagcacaaagaacgggaagatcttgtagttggagggcgaacgcgggaccaggtcgtcatagaccagcgccagatccggaaacacaaaatccgtcgcatccagacactcgagcggttcctgatccacccgctccagcagcacattaaacttgcgcgacacctcgtcatgcagcacatcaaagaatttgctcctaagcgacttgacgatcctcgggggtttgtccgtcttcttgccaccgagcccctgccgtgatgtccgccgctctgtcttggtcgtgacggccttggcatctgcattctcctcgctctcgatgatcttgatgacacgcacaatgaccgagccttgcttgttcttgatgaggtcgatcatgttgcgggatagctcccagagatactcttcaaattcctcgataaccttgtccaagcgcccaaagtactgcttcagcgtgaccttgacatctagaggttcgtcccgagccatatgcagggtggaattccggagctgctccagtttgtagagttgatagtgaaccaacagcaagttgggagccggtcccaacagatccttcatgtcctcgtacatcaaggtcttgaccctctccagatcctggtgcagttcctgaaagttgttgaccagtgtctgtgtcgctacaaagttctgatgtgtttgtgaaatctagtgggaggcccataagggttggccagcaagtacaaaaaaatggttggacgtggtatatgtaagtcctcctgttgtctcgcgttttgtgcgggtctgacttgtggtccatcaagttctcaaagcaaaaaaaaaaaaaaaaaaaaaaggtggtggtgcgcgttttcctttaccttgcggatgcgtggatagtcggtgatgagaccctgcgcgtctttgcagagagagtcgatgttcttcatgttggagcggatgccgaggacctgttccttggtggtgcctaggatatccagggcctccttggtctcctccatctggttctggacgccaatcttgagctgctgatcgacaatggccttttcgcgtgtcagcttctggcgcagggccacgagcgtggacaggtcgtccggatgcttgagcatggcggatatgatggcgacctttgcatcgggcgagatggaaatgacggactttgcgtccaccatgatgctcaatcagcctttgggcttatcaagctctgtctctttctctctcgctgttgcgggaaatggaaacgggagttgcacgggtctgcggaggggaggcttgaggatgggtgtagcgtggggcttgcgtgcgagtagaaagagagcaagagagatagagagcgacgcaagagatgcaacagatgagaaggcgaagcggggcgtgggcggacaggtgtgtgtgtgtgtgtgtaggtgtgaatgtgcaggggaacaaaagagggccgcaagacgagctgtatcctgaagggcaagtgccaggcttttttttctctcctgctgcacctcgctattttcgagcacgaccagagagcactttgctttgcaccgttcgtgctccactctgcactctgcacccgcactcttttcaactccatcccatcccatcgctccatcctcgccgtccgccaacacctccacacagcctcgcttccgcgcctcactgcccgcctgcacgctctgcgcccgccattcacccccacaccgccactgcccgcactcgtcgcagccaacatcatcacacaacccagacagtgaacatacccgagagtgatggtaaaaccactctgcccgctgctgataccgcatcaaacccgcagcagcaacaacaaaaacctcaatgcttccccttgctaatcaatctttcgttccccttcacctttcccatttcgaccagatccgctttatcctcgtccagaaccgccagggcaagacccgactgtcgaaatggtacgcaccgtacgaggatgacgagaaactaaagctcaagggcgaggtccatcgcctcgtcgcccccagggaccagaaataccaatccaactttgtcgagttccgcaacttcaagatcgtctaccgtcggtacgcaggcctctttttttgtctctgcgtcgacgccaacgacaacgaactggcctatctcgaggcgatccatttctttgtcgaagtcctcgatgccttctttggcaacgtctgcgagctcgatctcgtcttcaacttttacaaggtacacacacacacacgcatgcagctctctcctattctcttaccaaatcactagtgcctttttctcttcttgccgtttgtaaacgtatggatcctaacctcctcctcctgttgcggcaaaacccccccaacccaggtctactcaattttggatgaagtctttctcgcaggcgagattgaagagacaagtaaaaacgtagtcctgacaaggctggatcatctcgacaaactgtgaggacaaaaggacagtgcgcaaaaacaaatacaaccagcatcatggagccccgctatggtgtacaggcaccgagcaagccataataccaactttcacaataaaaaaaaatcaaggtgtcatcagccaaagcattattccaacaagccagctcaagcaacagcaggaagacggggaaggggtgggcaagcgagtattttctatggtacaaaaaaaaaaggccttcagcatgaaaagcaaggaagctctagagtatgcatgctcaagagtaaaagtcgacgagccggagtcgttgagcgtctcgaggatgtcgaacagcaatccctgcattgatcaattgttcgatatggggcggataatattctccaggcacaaggacgacataaggatcagatggccgactcacagacagattcataatgtcctccagaacgtgcttcaactcgaacgtcgctgggttatcatcctagatcagttttttggtcaacggttagacatgtatgcgcagaagcagcgtccatagacatgggcggtctgaactttcgtgtgtcatcttacatcaggctgaatagctggataatgtctgctcaggaacccagtcagctctcgcatcaattcctggacctgcaatcttgcctccagcatcttttgtcgtccttgactgctctccagactcgatgaggactcgatcgacagcgccagaccttcccgcctcgcctgcaaggcgcgtttgatctcgttcagttcactgagaagcttcttctccgaggccagctccgcctgcgtgtcgttcagctcctgctggagctgcggaatcacgatcccatagtcacggatcgaatcctgaaccatctgacgcacttttaatttggtgacttccggtagcgcctcgggatacacatcgcggtctaaaaaaaagtggtttgaatcgaaacgctggagtcagcatgtgcaccgcatttgttcataagaattttccatccttgattcgttctcccgacggcttactggactggatcttttggtagtctgattgtaggcgtgcttcctccaatcgaagaatttccagttgctgaggggggtgaaagtcgtcaacaagagcacacggaatggtcagtgatgaaggtatcgaccatggcgcaagttgcactcatcctcatactgagaacctactcgctctgctgttgagtttgatccctgtgttactgttggttgcttgtgcactagtcgtgcctttagctgtgggcaagcatggggaaagccaaaaaagaaccaagtcaggacgtggtctttctcgatgaatgatatcgactttacgctctttggtacattccatgttcgtcgtaccttctccaaacgctccagcttggtgatgcacctctggtgcaatatctctcctgtagcccgcaaggcctcctcacgttgacgtgcatatgcaggatcgcgctgagcgcgcgatggtttggggatggctgttacagatgtcgcgtctggtttggctgcatcctgagagttctcgtttaatgaggttagtcgactgtcctgttccgaagtcctgtgcagcatctcctccagctgtagtcgtttgcttaaatcctcttggctcatggggtgtcggcaagagatctttaacacacgttacaacgcgccttcaaaaaagcgcgtcgtgaccgtcaatcgacgtcacataaccctgcttttttttgggatcgtttcattactcgctgacagcactccttttcctgtccacaattcacctcacccacagcacgacggcaatgatcgaccctagcgcactcaaggtcacagagctcaaggcagagctaactgcacgcggactaccaaccaaaggtctgaaaaaggagcttgttgaccgactgcaggaagcgctggatgccgatggcacaaccgacgcccccgccgagtcagcatccgaaccagacgtcgcgcccaaggacccagtagcagtcgagcaaagcaatgccagtaaagacacggacatgacgacagaaccgacaacggaaacagaggcaaaggagatcgcgcaggtcgccgaacccgtggcagagcccatggcagccccagctctgaatgatctcgtcgccgcctcagtaccagagccagcagcccagaagaccaccgcatccgccgatgcagtgaagccagcaacggcactagaacctgctccagaatacagcaacatctcacaggagggcttgatcgatacaaccagttctgcaaccccttcagccgatgccgagtcaaggaaacgcaaccgcagcaacgaggactctgcaaatcaacagcaagaatcttcctctcccgacacaaccgcacctggcacgcccgtcaagaagcaaaagacgcttgcgatcaacagacaggacacggaaaagattgctgccgctgtgagggagtctgttgaggcggacgcacgtcgtcgcagtgctgctccttccccgtcacctgtacctgggcgctcgacatccaatacttccgtctcagccgctgctgacaatgcaacgacacttgccatccccgaggaaagttctgatcagacgacaccttcaggagcacctctatcacccaagggtgaccgagcagtgaataagcgcattgatgcacggtcgctgatggaaaggcagatcaagttggcagccatggatcgccagcctgaaggcgcatctccaacgacagtggatccagtggatgaggagatgctagtagaaggtacttgttcaacctgcataaaggtgcatgcgcctctctctgaatctatttcttttgtctagggcgaaaaaaaaaaactaaccgtggaccacaatgtccttgttagataatgatgttacaccaaaggctgccatccctatcgagacaacgcgctcgctcacaatcaccaactttgtcaggcccttgacggtcaaccaggttaaaagaatgctttcagaattcggcgaagtggaagtcttgtggatggatagcatccggacgcactgctatgtcactgtacgtatagcgaactgaaacgtctgagtggcagcaagcaccactctctctttttttttgttttgtttgttgaaaacaccccatcctaaccatttgaatccttgtggaatcactccactacagttcaaggagaaggaatcagcggagaaggcatacacgcaggtcaaaggacaaatttttccaaaggaaactggcaggccattagaacctcatttcatcacacccgaagccgcggcgtcgagcatcgaggctgcagaacttgcacaaaagagtggcaagaagcccgtcgtctacactggagtaggtgctgtagcggcggtggcgacgaccgctgcaccgaagagtgcggctcccatcgcgatacgcaaggatgatgtcgaaggtaagacaccagacacctttttcgagactcggtgacttaacttgacttcacgaaacgtttgctggatcttgtggagtctaatcatgatttttacattgggcaaatttttatgtttctgaacttgtcaatagtcatattccgacgggacaagattgtggtggagcagccgcagatcgtacagccagccgacctgttcaagttgacaaaggctcagcctccgctctactttaaaccgatgaaggagcctccagtacctgaagcgaccatcctttcaacagaagccgcgccagcggcggttacagaagccaactagctaggacaactttttttttcctttttttctttccctttcgttgctattacaattgaacactggaatagatcgttcaaagaatctgtacatgagatcatcctcttctacacatgatcaccacaaaccgtccgagagagtgtgagagccaataaaggtctggccagaaaaacgagatgaagtcattgtcgtgacttgagcgtagttcgttagtgataagttagctacgcgacactccaagcgcgttggtgatagtctatttttgcagcaggtacccttaggagcgagcagggcgtgacaatcccaggcttcgatcaactgatccaaagtctgttatagtacctatgacgaccggctccttatataatacacttgagtgtatgctagcgcatcccaacctcgtatcctcttcatccgctttacttatcacctcgaccgccatagcatccatccatgagcaaggcacgatgatactcaaggcaagatgatattgataccattgcacacactcgccaacacacatttgtttgacacatccttgggaacaccgcttgacgcagaaacatcacccacgcatcccacatctcacagacacctcacgcttccctgcacactcactctgtccctcgtcttgccttatcatccgtgctgttctcgcgtgcttgtccaacacttacactagcgacaccccccccccccccccgcctctcgttcctatgctctgatactgtgggtttgcactctctgttattcttgctccttcctctccgctcatctccctgtgattcagtctccctctctttctctctgtctcctcctctgtcttcgttttcttttttctctttccctttccacgtgagtgatatctggctagcaggttggaaagcccaccagagcagaggcgcgccttcgcttcggcggtctggtcatccggccataggtctcccgcccgcgtaagcccccatgttatcaccagttcaatactagaaccactcaacgcccctgacatcggtccgatgcattgccaatggctcatgactttctggcgagacctgtaaagagaaacagcaccatcttttcttctttttttattagcgttgtctgttttttttcattttccaaaaatcactcgctcaaacaaattccagaaaaacagagagtcctgctggtatgtcccgagagaaggaaaggaggacgaatgaaagaacaggcaggccaaaaaaaaatgtaggagggaggaagggggggcgggttccagaagaagatatttaagcctcggttctgacacgagcgttggcgttggtgacgcggatgttgagctgctgggcacgctcgacaatggcgatgcggttacgggacgagacgttgtgggcaatctcggcagcaaaggtgcggttgtgcatcaacaagaggttcaactcggcaatgttggacacgaggaacttcttgaagccagagggcatcaagtggcgggtgagcttgttgttaccgtaaccaatcttgggcatggcaatctggcccttgaaacggcgacgaacgcggttatcaatacccttgggctttctccatgactcctgcaaaatcgcgaaaaggaaagagcgagagagaggtatggctatgtcagtttctgtcacacaaggacaatcgtgaggtaaggtattgaagcccgcttgacttcctgctctgttcaaaaatcggtgttcagtcgcgggataataaagtgggtcgcaacgataagttgaaggggggattgagtccttgggaagcaaaaaaaaaggtcactgagacttctttcatcggctatgctgtgttcctgctcttcccacattgatcccaggttggcatcgctgcgttaaagcgttaaatctccttttgattcaactgtgctgtttttgcccattgcgtttccagagttcgacctggcgtgtcgtccatcgcagaaaagtatcattttccctgcaacagtccatgtcgcatatctccgtttcctgaacaagacccaacgagttatccctgcagcagtaccttgacggtcttgtagcggtcagactggtgacgcttgaaggtagcggtgtgcttcttcacgatggtgtgcttcttgagaggagtaaccattttctacagaaagaagatcgtttgaacggagccaaaaggtgctggtgtaagtccatcggggttctttgctttatccaacttgcaatcaaagaggcggggcgttgggcagcaagtcgttccatgaagtcctttgattcctggggagagatcctcgtccagatgtacgcccatccatatgcaactgtcccacgctctctccaacgcatcgagccattcgatgtcggatcagatttgcgggtatctatgatggcatagccccactgcgaggcagctcacagttggtccgtgttctgtcgttttgattcccggtcgacctttgcgtgcacagaatgttcatggggtgtgtcctccgccccccaaagagtgaatcagtgcagactgcattccatgtgccaagtgtgatcaccccgcatgaccctgactccgacaagtgagaaccaaagttcgaccctcctgcttcctgaatacgttccccgatgggatcgcaagactcctgagaccgatggatgagtggatcgatgcgcaacagttgacagatgctggatcctgacgaccgatgggtctctgtcaacgtccccccacatccatcctagatggatgtcgaacagtcacgtgcagacataacatacagaaaaataaatttcaaaagaggaagattcacttcgccgagggagctcagctgtcatatagaaatctctaagccttcattccacacgcgacagtggatatatccgcttttcgcttcgtgcctcattgtcgcgccaacaccccgtcatactcttacccttctctccgcttctttcgttcctcgctccccagtctttcgtctttcttggtcctccattttcttccgctactcttgcgcagttgctttcgcccattttgaaccgtactgcggatgtggaaagcggagacaaggaagttctttattctgtgccgaggcaggaccctgatgtcggtgtgggaagcgatctcagacttgataggcacacctcctacctgacaggtccgatacgttacacatcttaagcccgctctctcctcttctcccttccacatccctttttttttgctccactatcaaaagatgcgcacaagatcgatgcaaacaacaagaacagtttcatctatgcgtgaatgatgctgcgatttatgagagtctagtagaaaacagagcgggtcctgtgaaccttgacaggacgctgccctaacgtcaggtccagctgtgccgccttggcaaagtcccagatgaaaaagtctataaggatcgcattgactgtcatcatcttgggcacttgatccttggattcggcgctctctgccgcaagtgtctgcttctcctgaataagctccagaatcctttttcgaatcagctccacagcccagatagagttaccgcggatctcaacctccagttcagatccgttggggagcatctgcccgcgatcgaggacttgaagcaattcaggcgagtattgaaggcagtgaaaatggtagagtgcttgtggcacacggtagtctgcaaacatcgtgatcttatcaatgtcagtaaactttccataaccctcattctggaagcaggccctgtgagagttaaaaaagagcacacaagtcgcgtcagacattggctttgaccctgagaaagctggccgactcctttttgagccaacgtaagagtcatgacttaccagagatcggcgacgagaatctgggcgcgcttgaagatttgcactacagatatacacaggcacatgagtgagtaacccaaacttcttgccagctgccgtgcactcgtgtaccagaatgctaagctcctgtaccttttcgaccgcaaaactctgcctcgtctctgaacgaggagaagtttgaggtgacgatatcaaccagcttcaaggcggatccttcggcttggttgatgcagtttgcaaagttgccaccaaatttctatgggtgatcatcaaggccagtcagaaaatactgtgcgaccttccgccatatcccatgcaggcatagcgcaccattagacactcacttcaaccaagactcttccagcctcacggatcacgcgaatccgatcctgcaacagaggaatctgctcctttgtgtccgatcgaaatatcctagcgatctctgcgtctggtagttgctcctccgaagcaaagaaggaaggcgttgtgattggaatgccttcttccagcgctagaatagagaggtggatggttaggatatgtctcgggtattggcttaacaagatgggaggaaaacgtatggcttgttcgcaatacctctgttgatcgcagccaccatcgaccagtatcctgtatatccgacacccttgaacgagacccggtaccgatcaggatgagggacgcctgtgtcgtcgatgtcaatctcggaccagaacgaaaagttgagcagatccaccaaaaagatcctatcgagagagtccatcagcttttgccgtttttggagtaggaggaacagggatcgacgaagcaggatgtaaagatctaggcgacagaacctaccagtcaacagtgcttgcgttgcattcctttgggttcaagggatgctccttccactagtgttgtttgcatgtgttcaggggacagtgtcaacgttgtggtcgtcgtaaagcgtggacatgcagtgagataaaacccgtcgtgttttaccttgcttgtgtcgtagtgcgttttcttcatagcctcaaaaatctatccgttcagagatatgcacgatgagtactgcagactcgacctacccaaagtacaaggtgtctatccgggaatcttgacgcttaccttggcagcaccgtgattgatgccgtctttaggtatggaaacatgcttgctgtgctacaatgtgggttcaaagcgcgccgcgcgtggatgagtgagtgaggttggtaggttgtggcatcctgagcaatggcctggctttagatggtgcagctctattacgttgtgaatgaactctgcgctctcgactactggattgaggatcattgtggatcggcgtgcagggaaaggacctcgggggttgtgaagattagctgagcacaaggcagagagagcgagagagagaggtgggctatgcgatcgagcgaggggtgacttcgtttttcagttgagcagcactctcgttcgctcttttttttttttgtttcttcctcttccttctcgtcgtttcctcagtttctttccttccattcctcgcaacccttctcccacaaagtcatacatcaacacaatggtatgtctgcatgagaataaactttcaatactaaaagcgccgctgtccctctttttcgaacatatgggttggtttactttccgcactaacgcaatcagtacacgtcccctctgcacttgttctgctatcaggagcagaaaaccgttttcacggacaagcaggtggaggagttccaggagtgcttcaacacctttgatcggaatgccgatggctccatcaatcgccgcgagcttcacgcgcttctacacactgtcgggcacaaggtcaacccagagggctttgaggtcctcctgaaggaatttgatgtcgacacgtcgggtactattgactttcaagagttcatacttttggtggaccgtctgatgaagcacaagctgcagaatcagagctagttcaacacaaaaaaaaaagaccctcatctgggctatctttgacatccatatctctccccaccccttcgcccacagttcaacgggtcgtgttctttatctatccccatcacccatgccactcgtttattttatataatcatgtctactcgaaccataatcaaatacaaacctccgccagggccaaaagttctttcgttcaggaatgtgggctgttgaggctgtatgatgtatggtaggggcggatttttctttggcgtcttttgtgatttcttctatttcagatgcaaggtgagcatgcaatatgcagccacatcaccggtttcgaaaacgtgcgctttcccaggggaagtcagcttttttttttttttttgttcaatgcgcgagaccgtactgcttagcacattcacgttaccctcgtcttttctcaaaagacagaggaagtcagagagacaggtccaaggaaaaaaaagatgaaattgttagtccgaaccctgttgaacagctacacgactagctcactccttccagaggctccttcatcgcgtctttctcacagttttggagcgcgggaccatcattgggacacacagccagtgtctgctgtccacatgcgttttgcaaaagacagcgagggataggggtgggacggacctacagcgcaagagaggcaaagcgagagagcaggtccaaaagttcacttttggttgctgtggtttcactcagtgtcacactccctccaatgagacgaacccaatctcgtttcccacatccgaatgcggacatggcgggacagggacgggggacccttggtctgcaaaccgaggtgcagctttcgcgcactaggttgcgcttttttttctggctttccagtgcttccattccactttttgtacggcccattgtcctccgccccttgccatcctctctttcttcccctcgtccaccccatctcttgtccttgacccctccacttcctcatctctctctttctctcataacaaacatggtaagtggctcctctgaaaagtggcagtgcaaccgtcgagtgcgcgcatgcttcacagtcggagctgtgcatgacccctacgtgggccacagctgcgtggcagcttgcgtcttcttccctaccttccctaccttgtcttaaacaactctctcccatctggtgtgtcctgcatcgcgctttctctctctcactctctctctctccactggtaggcgtccaacttttcagaggaacaactcgccgacttcaaacatagcttcgatgcttttgacaaggacaatgacggctctattagcaaggccgagctgagatcgttgctccgtatagtcggcgaaaagttccacgcccccgacatcatcaactcgatgaaggagtttgacaccaacaacgaccaaaagatcgactttgacgagttcctagtgctggcccacaaactcgccaagaacaagaccccttagttactcggatcctctgccacccgtccacaagtctatgctttgttcttctcgatgcgagaactacctgtccatggactcagtaaggcaatagcaagggcccgccttgtatacacaacagagaataaaatgagcggagacatatgcctaagtctctttttcatcaacctccctcccccccctacaaggctggaagcaaaaggcagttggactcttagcgcagctgcaccaagggattggccagacatgactgaacctttgtcagagagcaaggatcacttccgtccgcaagtcagaacacggtttaattggggtagcacctttttattgaaatgacaagtttagtgagaatccgaaatgaagaaccctatgcaaggagaacgatgctcagggccaccggggccatgatctttactgccaaacggacaacccccttcacagcatccacacacgctctagcgctggacgatgtgcccctgtcgatcaacaatccgtcctcaccataaccctcgctcaaggaattgtcctgagcaaagtccttggtcaagctcttatgaatcgacctggtcagctcatgcccgaccgtatccgagtccatggaccagatgctgacgcctccaaatcccgccttctttagataatcaagcttaaagtcatatgtctcgggcgtgtcaaagcccacccactgatcgccatccaccaccatgtacatgcacttgccaatgtcgtccaatttcggctcctgtgtcaccactcgattaaagacatccgccgctcgcctctttgcatccgcaatcttcacattcttggccagcttgcttgcttcaaaataggacatggctcccttctcctgacaaccttgcttgcctggcccgatggcaggtgagccggggctggtcaaagtcttgtcccggagcgtgaaagtaacgccagaaagagataggcccaggttgaacttgcgggggtttacgatcttggggaccatggattttgcggcatcgtccacagagtagccgcggtactttgtattggccgctgtgtcgtaaagaggagccgcacagaacaccatatcctcccattgcctagaagagtgcaggacgaaatgccacatcaggcgtctgtgatagcgatgaagagcttgtcttcacccatgtcgcgtacagtgacttacccatgcaggttataggccatgatgttgaaccagtcaactagtcgacatttttcaagcaagaagtcagcaagcggaaagagaacagccctccaacacaacgtcaaatctggatcaacgaaacgcgcttttaccatagggcgtcaattttggaatcaaaaagtgttggccatgatagggtcctccaggcagggcaatactcaagatgaggcgttcttgaccgtcctggagagtctcggcgttggctgcctcacgcatctctttcaagaaccgaacaagattctctggatccgtgtcgtgtccacctcgcagtttgtcaccagggctatttttgtttaacaacatagaatgagtaagtcgcgtcacttttctagtggatcactaaagaagagcaacagacatagaatgggctgccatggcgagcgtgcacatactattcccagtcaaagtcgatgccgtcaaagttatgctcccgaacgaatgcgatggctgatttgatgaacttttggcgggactcggacgtggagaccatcgtggaatagtatgccatgtccatctcccatccacctacagcacaagttgtatgagacaaaaaaaaaattcaaaacgacgagtcagtgatccagccgacgaaagaggttacaaggtacgctacgccatcgaacataacgtgtgcggcgcttacccacagtgagcgtggtccgcagcgttggcttcttgactttcagggcgttgagctccttgtacatcgcgacatcctctggatggtaactcgccatgacaccctcaccattgatcagcacgaacgcaaagttcagatgcgtgtatagatcatatggcagttgagcaggcgcgaaggacgggtagtcaggacaggccccgctagtctaatatagaatccgatcgtttgaagcacagatgagggcgacgaggagaaaataagagaaaaaaaaatcaagggagcgcgcctgttaggtcaatggattccgattccacattcctatcgaccgtctagcctaacgcacacacgtccacaacgggagatatctctctctctcacagggttttgtgaagggacttgttgccactcttccttcatgacaagggttgattaggtcggctgagaagcaactgtgtgtacagtgagagactggctgggaagcagtgagggaaaggtacggcgtggcaacaagagttacagtggggtcgaccgattttttttatcaacagcataatctggaaaacaagctgaagtagcgatattccactgccataaaaaagttaacgagggatgggccaatggcagtaagaaaaagcgataggcctggtatggacttgggatactcggatgcctattcaaacgaagtaggttggtggtggccggccagagaggtctgcgttaccttgccatagtaacctacaacacgctgcgcgtgtgttatgactgagggaataacgagcgccgcgctcgccaaaaaagtgagcagcctcatgtgtagggggtgacgagggaatatacaaagattcgttgcgaggcaaggtgtgcgtgtcaaaggtgggtcgtagggatggttcgtgagggcggccggaaagcgcggttcgaaggaaagaggtatggcggacagagaaccaagggaagaacataacagcaacaaaaaaagagggtcaagagatgtgagacctggctgttttatatggatgacgggtgagtgacccttgctcgaaacgtattcttgttcgatccttcttctccctctcatcactcagtgggatgtccactttggctgaggagtggatcatcattcatgctgagctacacgctccaaggtcacggtcgcttccagatcctattccagcttgaccgtccgtaagcgatatctcgccgcagccccctctggctggcgctggctgaagacacctgagaggcgccagaaggtgtgaatgggcatgttgtgcagtgcttgcgtaccacaaggcgcgcaaatacgcaacggtgttccaggaaccacccttcatcgagctgttgtaactccttttgccagacattgcttgatgtattgcgtctgttgcatgtcgcagccgcgggagggatgcactgtcttcgaagcaggtagcaatgcatatgctgctgatagttactttgtatgtcatggccatcccaacgcatcctatagcctttttttttgtttatttgcaaaggtgctatcgcgtcgtgaggagagggatgtggtgaagagaggtagtttaaaaaaatgagagcggtggccagatcggctctcctctctttcctacaactgctcgattctgggatccgctgatccgaaagcaagcatcataggtcatgagaggagaagagagggaggccaaatcagaatctccaccacgcgatatatctctgtccctgaggtacatgcctcagtgcggaccagctacttcatggatgcatgaatccgatccctcagggcttgtgatcagccgtagaggagcacatgtgcacccttttttttcgtcaagcgcgggcaatgtcggtgtgaagcaaacgccgccatcatctcacgactaaaatgcgccccaaatcacacaaagtcgttcagcgcaccaaccatgctttagaactacaaagaatccccgtacaagacatagcacgtatattctgtcatttgtgcaaccaagttccttccccttccccttacttgctttggatcgggtccagcatggcgtgaaggcacccatagttcttcacgacccgcacaggacacaaaactcgaggccaaagcgtagtcaccgtccgaacggcacactataaaaggaaccgcgccccaagacggattttgctcttcacccgctctagctttttggctaagatcaagtgtagtatctgttcttattattctaatcgaataatagggtgcgctacggccgcccacaacgattaacacatttttgattgcagttggctccagctctggcttgctatctgtccagcggggtgtcctcggtcctgcaccactttccgagttgtacgctctgcagaaccttctcatctctttaaaaacaaaactaaaccgagaaatgaaaacgctgttgagaaatgggccttgccgtataacgtccttggtgagattcaacagttggggaggaccatcacacatcgaaagatcccagacctctttacagtgtgccaaaaatttcctctgcaccatcagttgcagccgttaccaaccatactgaccgcattcgcgcgctttttttcagaggctgatctggccacgaccttgccgatgctcgtggcctagtgcaagaattgtcctgaagcggtgccaccggtatggtaggcatctccagagcaaggactttcgtccaaaccgatcgaatcgttcgtccggccgaattcataaatctgcaagattcgccatcatctccaaaggtccctccccaagccgaacgggtcgattccgctactcacatagtgaaattcaccaatcactgaaaagagtgcctcatgccattcagcatgctctgaaaccatagggttagtaacgcgaaatgatcattctccaacattctcatcagccaagtcgccgtctgaagttgggatcagatgacgctagatcgctatcagtgagagggctggagtactctagggctcgcgatgcccgcccggcgccctcgaaggcaacgccaggcaacgccaggcactcaatgcgatccgcgaggactcgtcgggcacgctgcacggtgtttctgcagcgttttatttcagtgtcacaacgcaaaaactttgaacctagtagtgtccagggtaccagcgcctatacacctttatcagcgctggttcctgcaaatggtcgttgccggtgcaaaaacgattataattcgatgctgctggtatggttggcttctcccgagcgagcgcttcgtcccatgcgcttaacatacacattgtaaaggatttaagaaaaaaccttaagccagtagtatccaggctaccagcgcccaaatatctttgatcagcgctggtttttgcaaatggtcgttgccggtgcaaaaacaatgtcaattcgatgctgctggtactgttggcttctcccgagcgagcgctttgtcccatgcgcttaacatacacattgtaaaagtttccgcgaatttggtcctattcgcacccgttcatcgtctttctgcctttgatcagcgctggtttttgcaaatggtcgttgccggtgcaaaaacaatgataattcgatgctgctggtacggttggcttctcccgagcgagcgctttctcccatgcgcttaacgtacacagtgtaaatgtttccgtgaatttggtccttttcgcgcccgttcaccgtctttctgcctttgaaaagcagctcgattccgcaagtcagattgtctcgatgagcaatcgctggaaacagtgcctcacgatgctcggcacactctcacaggtcgggaaatgcggttgcaccgatcaggcaccaaaaatcgcattagcccaccctcacctccgaaagcatcgcacaggggttttagtgtatggatatagggtggtgtgctacgaggggctctagaacctttaatggctgcctggcgccctggacaacggcgccagcggcccacgatgactctctggcgtgttatacacgctgcacggtggttttgcagcgaattgttgcactttcagtgcgcgaaaaccttaaaaaacgaatccaggcacaagcacatttctaccaagactttaccatgagccctagttccttcatatggcccatatggatcatatatatcccattcggcgcttctcattggccgatcatgggcggttcttgcatatggtcttcaactttgtataaagcggtgtataaacgattatatcttgatgctgccggcatgcttggcttctccagagcgagggctttcgtccgagccgcttgattcgcaattataataggtttcgtgaatgtgcaagattcgagctcgtgaatcgacctctctctttggacttcgggtcgaatccgcaactcggatggtcaagatgagcaattgctgaaaacagtgcctcacgtcaatcagcacgctgtcaaacctcgagaaaagtgtttgcgatgagcaggcgacaagatctgcattagcaaagtcgcctccgaaaggtgtgcactgctgtctcagtccgcactatagcgctgcacggcgtcaagggctttcgatggcgacctggcgctcttggtaccaccggcagcagtctgtgaggactctttggcacattatacagcccgcacggtggttttgcagcgaattgttgcacggacagagcgcgaaaaccttaaaaatcgagttctggcacaggtacttttctactagggccttactatggccctgatatgttcctattagaaaccatacatagacccatccggcgattttcattggccgatcatgggcggttcttgcacatggtcttcaactttgtataaagcggtgtataaacgattacatctcgatgctgccggcatagttggcttctccagagcgagggctttcgtccgagccgcttgattcgcaattataatacttttcgtgaattcgcaatattcgcactcgtccaattcccttctgcctttgacgaccagtttacaagtatgaaaaaaaggagctgacacccccacggcattgagcaagcccttaaggctccagaaaaatgtgtgccatgtgcaggaggcgtggtatgcagtaaaaaagtcaagtagaaaacagagcgttcaggcgatttataaatcaccatggccagccagcagtgcagccctgagctttcttgtagaccctgacgcgtcggacagcatggtcaagtgttttacaagtccaggagggatgcagtgaggtgcgcggtgtgaagtttttgtacggagtttggccgctacgcttgctgaaaaaccttgtaaacgtacacgctacactttagtgccctgttttgtgtcggcgtttttgcggtgatgagttctgaacctccctgctgcgcccacgccataacaggcagctctgagctcgatcgctttgcgctcagcctggcacgaggtcgtcgcccccctgtattcatgttcactttctgcatgttcactgcttcagagatcggattagatctgcaatggtagcacggcataccatgcagccgttgctaacgctgcctgggtgcacctgcgtcgtccgcgtgcagtcaagactcgttcctaccgaggtcccttgttgcccctgagctgacacggctggtcatgaccatggtagggtgtggggataccatggccagcgggaatgttggcggtacaacggggaaaaaggagcgagcagtacgcgggaggatcggtccgacacacgcgacgaagctttctggcccctttattctcccagcgtggctttcttttttttttttaactctcttcccgtgctgttgatccccattgcttgcatcgccccttctctctgtcctctctgtcctctccattcttactcccctgcctctgggctgtcactgcaccacccttgcactcacgctctttctctctctttctgcaaacactctcgggccagtcaagtagcccgacctcgagtctttacgtttgacgtagattccccctttgtctcaaagccaattcagcatgacaatcgacgacagcgagatgcaaaagttgtggaagctcacaaatgagctcacggcccagctggtgttcaacaggaatgccacgttggagttgaaacagcagcttgcggaccttcaagaaaaaacccgtcaagcaccgcttgtggcatccagcttcagagcccaccagaacaatggtggcaacggttcaggtaaagaaaacgaaaaaaaaaacttgtttgcgtttgctgcattgctgccttcggttgaccaggaataccacattgtcgttggtgaactgccttaactgaccagctagctttttttccccttcttgtgaataccaacagatccgcccgactacaagcttcggatagccaacgagcgcttgcgcgaagagaattcacagctgcaggaacaagtgcgcgagtatgagcgttggatggagtatatcatgaccaagttccgtcttcaaaacgtaagggatacgcctccattctctccacggttctgtgagaacacatcagacacgactcttgacactgaactaaccaaccaacccgcggatcgtaatatgcttttatctagtttgccatggcgcagacccgtcgggagtctatgcacgaggcctacaagatgacggagcagggaaacgaggtcgccatgcggctgcaggaggagaatgcactgttgcaggcgcggctctcggaactcggcaatgtggcccgcaaagccatccacgaggagcagtatttcaccaccgagacgctgatcgagtctctggaaagcgaaaaccgaaccctccgggagatgctcggtgttgccgaggggggcatgggccctgttgcagggcggatccactttagaggagacgaggatgatgaggacgaggatggcatgcgccgtgcgggcaatagagtctcgttccctagcacgggcactggatcaaacgtcgcatccagcgggagtgaccatgagcagcagcgacgaccgcagtggggacggccagagcagccgcgctcccctcgtcaacaacggagtcaaggaacaagatcggggctgaagtcaccagtctccccgcttacggtgcaaacaggcgtcctgcgatctcccaagtcttcgtcgtcctctgcttccacggacgcgtcttcctcaccgcgttccaccagcacatccacatccacctcccctacctctccgtggtccgcatccacaagcacgtccagttcaactgtggtctcgccacagatgcgtccgcaagattctccacaggaacccaagtccctgcagccagtatcagtaactgagggctccaccatgacaaatgagtcatcaagagtggatggagaaggcagggagcacggtcgccgcagcaagatcgcggtcctcacgaagctcgtgtcgcctgtggagagcaaggaggcgtaacggcctccgtttcgcatagagcactcacaataaacacccgtgagatgcaatcaaacgtcctcatcgtgtccctcattatttgaccaggatgcagagttccagtaccaattcatgggactggagcgcattgccggtagcgggtgattccgtcgctgagaagcggattccctgcgcgttgtgttgatccaaacgttatcaatactaaacggatctggatgctaggatggatcgagaccatgacatctagccaactgcacatacatgctgagacgccaacggttgcagcaacaaaaggcagaagatcagcgttttcttgcgacctcagttttaccacccccccccccccccctcaaggatctgccgccaatgcgccctacttattccatcgttgtactggcgattgtcgtctctactcaagctttacaaacccaactgcaagagtccgacaaagtcgagctgaatgagcagcagcacgaggctgccttttcatcgccacccccttcgtctctgacaccctcgtcgtcttctgtccaacagccaccagagtttccgacaacgcctgcagagacgatcaagagtccgcttgaggttgtcaaggatgcgattcaacagatcatgatccacctgccctcgaaagccccagagccgcttttcgagaccacggccacttactgccaggcattcaataccctgtgtaccttagcctgcgaggagaagcgccagcagaagcatgccagagtggacgatgctccgaaagatgctgatgttgccgacaaatgtgcgaatcctcaaggaacgtccatcgcgctggcgggcgcagcgtgcagatgcctgggtcttgacctcacagaaccaatcaacactgcaatgtaagtatcctcctagactaacgtgcttcaagacccccccccccttcacgcatgcgcagggacgatgttttgagttgaaaattgacgttcttccacacacaatggtgttacttccgaaatagcgcaggaggcgcgactggaccccgatcgcaggttgagagcagctctactgcctacgatccacagaatccgatttccagcatccccatggatctggtgcgtgtcgtgcagagtgcctgtcaggccattggcatgcaaggtgactctaagcccgtgccagcagaggcagcctccgtcgtggggggtgtgctgaggtccgtggcaggcctgatccctgggtttggagtcgtgagcgcgctcctgccatcgatccctctcatcagcaaacttattggcagcgggggcggtgatcatgtagcacctgagagtgctggtctagatcctgatttgtctgcgaatacaacagggtctgagcaaggccaggcgttgttgactatgccgggttccaaggcagcggcatccatcccagcagagggcagtggagagggagaggggccaggaggcatcgttggatggatctcgcacgttctggggatcaatggccattgaaaaagtgcgacaaagagtggttaatggagtatgaggcgaccctattttttttttattctctaggtgtctaggtaaaatcaaagcgctcgactagatcttgaacggccttccagccttcgagattataccacttgcgtcggacaatgatctgtacatgtgcctcgtgcgcgataaacactccgatctttgtccagtccatctctgcatgatatccctccgcgaccaattgtgccagctccagcctggatttggaggccaatgttgaggatgaggccgaggatgacagcttggtcgtgtttgtttcgcgtgaagaggagctggatctcgaggatgacctggaagacgaggaggacgacgacgtcttggatgatgatttcttgggcttcttgaacaaccccttcgcgctgccgttcaccacgcccacctcggtggtggtgcttgcctttggcagtgcctctgacgttgtgctctgtgctctgtgatcgctatccgtcgcctctgaagcgccttccttcgtcttcacagcttcagcagcagaagcagctgctgcagggacatgatcgaccacgacaatgggcgagggttcgtccgctatgctcaaaaacttgtccttggtcgggacgttgggaaacaagagggcgagggtgctggtgacggccgagtggtataagttctttctgggttgggtggctgcgccctcgggtgaaaagaactggtccatatcaaaggtagggatgcccatcatggacgaggtcttgaaccgaacggccatgtcgttttcaatgttggcgtaggaggtccggtcttggaaccgcttcaggattctgctggaggcggaacctgggcgtgccatggccagcagcagcggtcctggttcgcgatcgagtgtgcaatcgaacgtggtggtcgtggcagtggtgggtgtcgtggtgatggcgtctggggtgttgtgggtctctgtgtcggctgtgcccttttcttctttgcttgtagtgggtgatgatgtagacaacgatgacgctgaggaggattgtttgagctgcttgggggagcggtgttcgagcgcaaggtccttccctgtttgtccgatacatccgagagagagagcaaagccaaggacccacgggtgctcaaacccgatgccgaggagcggcgtggccatggagatgaagtgagctggttgaatgctgttgaagaacgcgccgttggtcacgtcgtcgatgtatccaagcgcgtaaatgtttatcagaccgccgagcgagtgaccaatgatggacacttttgaaaatccgcgagggaagggccgtcgagcattcctgttttgagcagctgaacctgttgaggacgatgacgacagtgttgcggaggcagacgacacttttgtcgaaggtgtggtgctggtggcggtggtcgtcgtcgactgtcggaggtgcttaccctgctctgtgtcgcagtagccggtgaactccaagatatcgagggccacgcgttgcccggccatttgaatgccctcctctgtccctgcatggttggtgtctgtgaggaaagtcactgtcttgccgttgtgtgcgttccgagcgtcgatctgctccttgatgtacagcatgtcgagccatgttccatggatgccatgcgtcaacaggaccaagtgaagaccctcagcatcctgatcctcctgaacgtcagggaacgtaggcccgcagatggctgccgtgtccttgtactcgcacgacacgaggctcggttgcagaatctgtggtaccacctcaacgtctgatccaccactcgctggatcgctgctactgccgttactgctgctgttgttgttgttgtggctattgctattgctcttgctgtcgaccatgcccaaggcacactcctttggaacagcaaacacctcgaccttgaggtcgacccagttgcgctggagaaccatttccgacaagacttcgagctcccattcgttgcagccctcctcgaccttatcactctggctttcgctcctgggatccacgacttttgcgtccagccggcagacctgggcgcagcctatgaaggggacgagctcaggcacggctggtgtcttgttggggtttctgaccagggccaccgagattttccagggtccggatccgggggtgaggttgcggtagaccggcgaggagttgcggacacggaactggagggagtcgatgttggagagttggtcagggttgagtttgatgcggtagcggacgatgccgccgacggagagcgacagcttgtgctggatcagcagcagcggctttggggacatggtgctgcgggcgggagggaatgggatggtgggagtggtggtgaaggcgacgagagcaaggatggagagcgcaagaagtagagaggaggcgaggaaggcgtgcgatgtggatgcgagggatgcgagggatgcgagggatgcgagcaacgggacactcgccatggcgtgaacgaatgaagaccacactcggcagctcgtggcaagggggggaatatgacgtctggtgcctattctattttgttggctgttgtgtctgtcgcagcacgtcctcaacattgcgctgctctgttacaaatagatatctcaggtttactggtgtgcgttgtctatgcgtgatggatgtaaagtacattgtggtggtgttggtggtggtggggtatatatgtacagagggggggctaagatgactgtcagtctacttcttctttcgaagactcagcctacgcataaagctcaggcctcgactcggcctaggcgctaactcgttgccagacagaccactgctcgtcgacgaaaaggacgtgtcatggctctcgccatccgccaggtaatcgtcttggtccaaaagcaactcctgctgctgctgctgttgcttttggatcgtctcagcatcgactgcaaaatcggcctccaagaaggtgtgtccgcggacaacggctgcctggaactcattcatggcctcgatgcggctaggcatcacgtctgtcggcatcgagctcgtcgaatggcgaggagaggccggggctgaggccataggcgattgcgtgggcgaagggaatccaaacgcggcaaacgtcgtgtgctccatggcaggatcgcggctcgagcgatacgtcagacctgggacagaaggacacgtctttgtacccgatgcgggagcaatgggatccagggcagcccgtgacggcacgcccaaagcagtaaacgtcgtgaacgagcgcgaatcggatcgaccacgggacaagaggcgatgggctccagcggctgccgacgacgagaagactggcggcgtggtcctgccactgccatctgacgactctgatgcggtgcttgactggccaaaggacgcaggagaaccagggggttgaagcaatgaagacgttgactgggtctgactatggccagggtgggaaaacagctggtgcagtcggttgggcgactgggcgcgctgtgaatcactgccggactttttgctggctcgtttgaacaggctgaaatgctgctgctgttcgacttcggggccagatttagcttggtcgccctcggatccatagccgcaaccagtcgcgtgggccacagagggtgggcgacatccgaaatcatacgatgcaggacgctgctgactcttgaaaagattcttgaacttgtggcgctcgagctcttgtggaaacgaggtcccgtaagaggtcgaaatcacagagttgggagctccaagaccctcaatgtactctgcagacgtcgcatagtagtaggcatcaccgcaaagggaagggccagccgcttctgtacccgtagaacccggagcgtagttctctccccggtcagacgcaaggatgtaccggtgctgcagattggccagcgccaacagacgctgttgctctcgctctgtccactgttgttccagctcgcgcttgtaccgttgaggatggacgatgcggtatatgaaattcttgttcgttctagcagagccttggcgttctagcggggtactagcatcgcccctggcgcttggcgttgcactcggatggctgttgggtcgagctgttccaagagacaacgagcgccttgcccgcatgcccagtaaaggcaaagatcttggtgaagatggcacctcagattctgattccatggctgatgtgtccacagttgccaaatgtgctggaagcgctcgtgggttctttgcgacggtacttgattccgaaaacgttgcggaatgacgggccgtgctctggaggggctcagcactgcgttggttttgctgttggtggcgatggagaaacgagccgatcttcatagggaccgagatagaccgcttcaaatctcgcgttgtagcggtaactggaccggagggggccgctacagaggacgtgaacgagctgctggcagttggggagggggacatgctctgcgttggttgactgcgcgagttgtcaagcttaaacaacggcgacgagatgcccgagccattggcgtcctcagaggccattctctgttgatggagcagctcaccctgaaccatagcagagtgatgtgtgtgttcatttgtcgctactgcatcagacatgccgcgcatatggtcggcttgcttggcggcagatattgacagttgaatatccttctgctgcgccgatgactgggactgttcagcgtctacatgttcatcatcaaggccgatggccgtcatcgacacggtgctggacgagacggacagctgcgagacttgactggatcgcctgcgaccaaagacaagcacctgctcattgaaggtaacgcgcttgctgttggcggacctgatgttgccagagagtgtcctcaccaaggcccgtcgtaacctgcttgtatagcgctcctccaattcctggctctctgccgagaccgcatcgccctcgacctcgtgctccagatcttcttggattctgttttcctctgcattccacagcgaagggatccactgctgatacttgaacaacctcttgcgcaacgtcgagttcatggattgccgaattgtccatcgctgctgacactcttcagattgatacccgtcatcgaccagatcgtcccctccttttaacgaggcctgtgcattccaataccggctacttttcctttgtcctcgaggtctgcacgctagggggtcggggcactcatcctcagagtctgcagaatcgatatccatggctggaaacacaaaccctgggaatcgactatcccactccagcatgagtggtttgtgggcctgaatccagtccaggttctcgagcgtgacggtgatcatgatgagctgtgccactgagaggatgacggacagtaggtagatagtgcagccgtgaatggttgcgaccgaatactggagcatcagcagcacggccgggtgctcctggatgcacctgcccagtcgttggtaaaactccagcaggaagtggtagatgaacagtttttggtcgtagaaaaggggcgagaaaaagctgaacgaaacagactctgatgctagactcaagtccgaggaagaggagatcgtggaggtcgttggggagcaagaggcagaggaggtggccgagtgggttgctgggagggtgatggtcaagacgggtgtcgatggaggtggtggtacaagcgcaggcacggactgcttttcacacggctgactctgcttcagcggtggttgttccggcaaagagcttggcgctggtcgctgtgcaggatcagcgagcgacgatgctagggctctgcgatgctgcccagccagactgtgcttctcagcatccaccagcaccttcatggttgctatagccgacatgggttgaagcggatggctatggcgcccagctggctacagcagacagggagagggaggatggcggcggggtcgcggagaagtggcggcgctttggaggtggaatggtgacgagcgctgtagagtggatgcggggagagctgagagtgattgcctggttgagcgggcagcgtgtgtctgtgagcagagagtcgaaaagaagcgacagggtatggttgcgagtgtgctgatcggatgtttttgttgccggccaaaaggagattgaaatatttttatggtgctctgcgagtgtggacagaaatcgttcgccctgaagacgtgtctcgagagcagtgagagatcggatcagaccaagggttgtctacaagatgtgaggaggtaagcaagaggacatgtggtatggttaggtgaaaatggacattactcccctcggtacgacgtactcagagtcttgtggagttgcataagactggaaaaggggacgctgaacagcatatgtcagcgaaagggggacggcgggcgagacagcatgaggccgttgtgcagcccttctgcatgctgtggtgaaaacaagctccacacagaagcgcaacaggatggccgaatagggtgagttgaccgcaagttgtggcaggaagggcctgtgatgccagcgaagggatgaatgatgatgttggtccgagcggatcgcgagcgggaagcgtagcaggggagggcaggtgcggttgcggtaagaaggaaagaaaggggatggaagagaaaaggggagggatagcgaacacaaaggtttgcgttcaaggcgcgaggtgctgtcgttcactaggcatgggcgaatcgtgctgctgatgcttaccttgtcgataaaggtagggacggcttgacgtttagagcgttgaaaaagttgtacactgagggaacgcggaggggaggagcgaggacagcaagagagtggacagtgttgtcagcaaaggtggatggacagtgcctcgaggaagtgaacgaagaaagctgagagtgaagagtgagagagagagagagcgaagtgaacgaaagaaggaaagagagcgagcagagatgaagtgaactgaaaaaaaaacaaaaataaaataaaaaagtcatatcgccggagttggagtcgacaacaacatgtgtgcggctacatgcgtgcaccgcacttccatatatggaggaacctctcctcgggcgaggcggaactttgatgccgaccgaatagaacgcacacaaacttgaactgagtaaaccgtaatatacgaacgagggtagagttcacagtcaggtccagagggaggaaagcaccagaactgccgctttttcggatttgctctcaagtcatcacaaccctatccgtgtcaaattgtaaagggcatttgttgggtgacagcaaggcacaatctcagatgtgggaccttggcgggaagtggcaagagagcaagttgaatcagggtgcttcgatgataccatcaggaaaggggacaagggatgaagtgagacgcccagttgaatccacttacaactacaataggtgctgggaatgaagactggtagaacaatatgccggccagggccatccctgatatataggcgcgaactcgcagcatagcatagataaaccctttctgatgcattgccaacatatgtggaagacaacgcctgttgggaacaacgcaggaacaacgaggaatacaggaaggggaaaaaaacatgccaagaagtatgaatactaacatgcagagcaaggtcaggtccgggaaatgactgtgagtgccgatggattatgcagaagggcggataggggatgcacgaaaaagaaggacaagaggtaagaagggatagcaaaataacagcaacgagccatcagggggcgcgaaagcgatagagcgagcatcgagacgcttcatatcaaagagccaccctcctccgctggagttcagaggctacatgatctggcccgcactaccggcgtacaacggcgcacaagggcatccgcgcgctctgttggacattaccaacaagtcagccagccagccagcaatcatggtggtaaaaagaagtgtgataaatgtgatcaaagcaaagaagcacgagggaagaacagtgattgagacggggcgatagatctcaaaccagcgccacagcccggctttgcaagagtattgtcggctttgagagatcatggcggtacgtgattttgaaagtgtgcctccaaaaacaccttggcaaagtggcgcatcagcatcattcacctaccagtgacgagatgtcgactgctgtagccaagattttttttttgttggctgtggggacgggagaggtgcgaagtttttgagaggccagcggtgtcgctaagggatgtcaaaaggggagattcagaggagaagggcactgtgagctgtcttttatgtgtctcttgcccctgctccactggactacgcatctgcgcggaacgcgcgtcttttgtttggatccgtcccgttctgcggcagtcgacatattctcctttttggttaccaacacccgagctctgggctggtgcgcgagtgagtccttggccaatgcatttacatgccttgattacttctctcgacgcacgtcgacgcatctgttgaccattccacaagggcccttgtcccttgcagtagtggagccagagatagcgtaggaatctcatacagaagatcggcccgacaccatagagcgtcttgcgtcggcctacgatgagccccccggacattcaaatcccggcgacagtcagacatgtggaagcacaagccagctccgctttcggcgacatcaattgccgatcgccgtgcactgacggataagtccgtatgcgtcctagactgtattgtgccctggtcaaggaagcatagaccccgaggatctcggaagggactgtgcaacaaaggacctcgcacaaaagattatgtcataaaagcaatccaccgactgacaaaggcctagccttctcgttgtatgtgcactgtattcttttaacagatcgatcgaacacatcgttttgctacgcagttgtcgcttttgtaataccaaccattctttctcgtcttggaagaacaggcaagattgtggttagacaaaaccggatcgcgtccaagaaatttttttgttgtcaacactacccacctggacaacattgccacaagagccgagaagcatcaacatggctataccatgaagccgcttgcaccaccctcttgcattgcacatgtaaggaagaagcctctcacccttgttacagtgagtgctggttgatagtaggcctacaaaccacaaagagcggaaaaagcgatcttccgatcactccgacaacattagccacgtccacttgacacccaagtagcaaaatcgcaactcgctcactgtcgcgtgcagatgtgtgttgacaaacctgctggcaggaaacaggttatggtagccttgttgcgctgcgtctgcgcacactgctgaataaggcaaaagtatgagcccttgtttgcacctgtgcattcctctctcccattcgagagtccatgaaagccgtgggcggtggtcattcgtgcgtcttgcacagcctgacgaaatcgcgttcactttgtaccacctccggacccgcatgcagcgccctgaaagaactttttgtcacgagctagtaagccaaatggtgcaacgttcaccagcaccgctgtggatatcaattgtagagaggaatgtggtaaaatggcactgtctgtgacaacgggcgccaatgcctcttcatcgagcgctgtgtgatgcaggcggatgcctcttggacacccacctcaggcagaagagaccacaggcacacatgttattgattggctacgtgccatggagtgtgaaaatatggagtataaggggtcgctgaccgaattctgaatccgatgggccgctttcatcgtcttttcacccctccagcatctaaaagacgaaaaacaccactcacatcggacagacggagggcattgcacaaggacagcaggggactaggcatcaggacaagtgcccgagagcaacatgacgacctacaacagcattagccatgcgtctgcaccccgggcgattcaagctcggccgccgcagcgagcatggtgtcaccgggaccagcagcgccgggacgtggaagaggaggccggcgggacatccgagacatcctcggtcctgtcggcatccctctacggcaccaccacgatgctgccgttggcgccgccgacctggcgagagcgaatgtcgaatctgctgtccaaacggttcttgaccatcctgctactgggtcaattgctctcgctctgcatcactgccacgaccattttcacaaccaagctagcccagggcgacaacccagtctcgatcccgaccacgcagtccttcctgaactaccttgtgctcggcttggtgtacacagccgtcacgatctacaaggatggcttctggggctggatcagcatgatgcggcggcgggctgcttactgtaagcgagagccttactttattagcatgctagagcaaaggaacgtgcatgcaagctgtacgtgtcgatggacgctgaccgtgttctctttgtgctagatatgctgtttgctctcattgatgtcgaaggaaactacttcgtggtgaaggcgtacagctacacctcgcttctctcggccatgctgttggatgcctggaccattccttgcgtcgtcctcttgtcggtgttcttcctcaaaatgcgcttcattcggtcgcattatctgggcgtggtgctggccatgtccggcatgggcttcttgatctggtcggacatggaggctgggaaggacttcccgggctcggactacgtcaagggagatctcttttgcgtcctcggagccaccctttacgcggtttcgaacgtctaccaggagttcttggttcgacagacacccatgtacgaggtcgtggggcaactgggcttctgggcaacgtttctcaatggcggccaactggccattctggaacggaatgagattcgaaatgtcaagtggacgccacaggtggtcttgtacatcgttggattcgatgttgcgctttttatcatgtactcggtctcgcctttgctgttccgtctctcgtccgccaccttcttcaacctcagtctgttgacgagtgacttttatggtctgatctttggtatcttcctctttaatgccaaggtaagactgggagagagagacttgacacaaaatgtttttaccgccatacgagcgtccgcacgagtgaagttttcatgatcttttcccctagttttgaagttactgaaatgacgccttgatgtctttgtcgtttttgaatgttggcttagatcaatcgactctatccgattgcgtatgtgctcattattgcaggcatcattgtctacaacatctacccagcgcccgagcctcagttcgaaaagatacttcagcgcgagatggatgataaagatgaggacgaggagcgcgcctcgccgcccagggcggatggcaacatggtctaagaacgcgttcatgatgtttcttatcgacctgggcggtatagagagacggcctcgtttacaatgtcataaattgtcccttgcacgatcgggttttttcaaatacaagtgggcgacatctacaaattgtttgcagcaaggaccatatcaagctgcttagctcctttcaaaaacgcatgggagagaaaacaaaagaaaaggcatgttgcatcataccccgatcactgcgatcacctatgagcttggggtaccgcagtcgagtaatgagggtgaatgatgaaacattggctcgctcagccatgatgaaagactgacccttcattttcgactcacacatcgtctgctcctcttggagtgtgtgggtcattttttttttcttttggtcttgactggcagcaatagatggatcgaaatcgttgatccaattgccaacgtgctcattaaatgtttgatggtgatgttgtctacatctatacctgtccccagagcccctccccccctatcctcctctttttttccctcctccaagtttaataaaacacatactcgggcgcggagatggattacaaagatgagagaccggggggtacgcgacagcaaataaacttgtaattattttgtagagtacagataccatacacactgatttcccccgatcgctcctcggtcccagcataccggcattcatttcattgcgcctcctttggcaggtcttgagtcatgagctgtcggctctcagtcgaacttgcgtggacgaggtacacttttttttaccgcggagattatacgacggccccagtacgatgatactttttttttgtgctcactcgaaaaaaaaaaagaagtgacagaaaaagatttagttggttcctgcggcatctgcacagcccgcttgaagcactagcccttttctgtcgttttttttactactacggcaggttttgtgttctctgtggcgttttggatgcccacgtagtacagagatggggtacatcattgagagagagagagaggaatgcaattgacaagaaaacgagagccctatccgtaaattattggcccagagcgtgccatgttttttttctgcgaaggtgtttttgtatatcgtacaatagcgctttatgatgcttttttttccgggtgaggtctgatgaagaagagtcagagctcgcttaactatgcgtttggatggagagaacaagagtgggactatacacaggatggagagatgatggatgagaggaaggggggcgggggggggggggggctacacagctatgctattttttttccattttagcagatgttctttgctcttgcgcgcgcagccatcaacttttccgtctcatggctagcagggtgcactccatcgttccttgcggccttgacagtgaagtgtctcaggagcgcatcccgtctcacaaagggcctctggcagaattcacagggccatgacttgtcctgatgcttggacgcttggtgacgctttagatcatgaatacgaccgtacgtctcgcccgggcagagttcgcagcggaaggacatggattccgttgcagcgttgtagaccatgatagagccgtcctcggatcggatcactgtcattccctctgtgccgggaaggtttgtgatgatcgtgctggacgccgagttagccagtgtgtgtgctgcggttgattcagatgctgcggtcacatcgggtgatacaatgttgaccatggacgtggcatgtgctggcgacgcgcaagtagtggatgccatcgaaggcgaagcagctgcggatccagtgtaatacgtggtcaaaggcgatgatggcattgaaccatgaaatgtctgctcgggtgattcaggatgactctgggtgccgtcggaggtgcatcgcgtgttgcgacttgggtgtgccctgtggtaaggagatgagggcatggccggagagagtgatcccgagcgttgaggtcctccgcgagtgctgtggcactggttctgcaaggactggtagtgctggcgctgttgttgctgatgctgcatcaattgctgctggtactgcatctggaaatactccgtctgctcttgtttgatcaattcgttctcaaagtccagcgcggccatgatgtgctggtcctgcggcagattcgagaagagggtggcctggttcgaaaagtcttgtggatcttgctgcgagagtgggtttccagacagcaagtcctcgatggtaatattgaacatgtcgaccaattcatcggcctcatcagtctcgatcattctcagcaatcctgcggcagggctcgagtgggcagaaccagagtcggtcgagaatggagaagaagagccagagaagcaggagagcgcaggagatatgggagaatagaaatcctgctggaggctgaattcgttccaggcaggaacagggctcacgagcgcattgataaagtcctggctctggtgaggctgctgctgctgctgctgctgcaattgagcgtactcgtgttgttgccgtggatcttcatggtcgtagagagttgtatacatcttgctgatctcgtccgtggtctcacggcgcaaagacgccgaaggctgctgttggtcttggttgaacatcgttgtgtgtgtgtgaatgggtgagagtaagggtatatagactgagtgcaaggaggggcggatgcgaaaagaaaagtagagcaattgagggaaaagggccgactatttatctcgcggaatatatctgccaagcagttattgttgctctgagcgttgttttttggggctgtgtggataatggaaaattggaggatgagggggcgccttttttataatggtccagaggaggaggtcaaacgagattctgcgtcaaacgagacagggacatttctcgattgactgtggaggctgaatgcttgggcgtagcagcatgcatcgggttacccagggcatggcattgaacgcggtcttcacttgacccatgggctctcatggaaccctaatatttccttctgcggcctagtcccgtcgcacatccatcgtcagtcccatttgaccttgcgtgttcacacctacccatcctcacatggtgccccatggtcatccttcaccatccctcaccatcccgcaacactctcgcaccaaacctctcagatccaagtccctacagtggaagtactcacaagccccactacaaacacgaaatctctgagggcgccgtggtccctgagctgatgaaacttcgctgaccaatcgcacacactgatccctccttgacgaagcgtatagctggaagggagtggtagtgtggtactgcagccgataaagccctgggagaggtgctctcctcaccgcacatttcacgccaaaacgacactcgcgaaaaacccaactccgaaaccaactgccgaaaccaatttccatgacatttgtcgattttagctcttacaggtggcgataaaggaggcagagctatgttggcacggcctcgtcaaatcagcactgcccaactgtcgatccatgtgtcacacaaaaattgccgcacagagaattggagatttcctttttgatcgcgccttgccgtgtcctgcgttctgagccatgtaacgaaccttattcgccggctattgagtgcagaagcaagtcactcaagcttcacgcgccaggtgcgtaacttccgttgccctcctgcggcaggtcgtagaactgtctcctcccttgtacccaactctctcctccacactccagtgatcaagcttaaaagcacaacttgctcgagtcctcatctgttgaactgccacgtagtgtgtccccgctgcgttcggatgggcctctcccaccgacctctctctctttttttttttttgcgagcttgactgacctcatgcgcccagaccatgccccgcccttcggatttctgtgaggagggaatagcgctggatttcccaagtatccacttacaagcaggttcggcgtggtcgtccatgcaacggcgcgcgagcgccgggcccaaggcagccatgatcaaatagaggtagtcactatgcatgcaagagcggagaacaaggcagcagatgagcttttttttcatgcctgttaatgccatgacatcgatgtcacacgagagaaccaaggaatggaaagatccttatcgaacccagacatcgcggcagtagattgtgggtggtgaccgcgaccgaggtggagaccgggcccatggtagggttctgtcggttttgaggatggaggcgttgacgcagttctagtggtggtcgagttgctgtcacattctcctcgcgatgggtagatggctaagaagatgagtctgtgggtggatgtatgggtggtgcgtgtgtggtcggttgagcagaatgcgacgggtagcgcgctcaggaggcaaggttaggcacgtgggctgcatggatgcatggtgtgcaagaggacaggagagcaagagagccagcggacaggtccacgagcacgagcaccgacgagagcagagtgggtacgcagggtagatgggtggccttgacggcgacggcggatggcaaggacgagtcggatggagtgaagtggaatggacgagaagcgaaaggaaaaaaaaaaagtcaaaaagtcaaaaagtcgacgagtcaaacaggtcaaacaagtcaaacagattttttcctgctcatgcttcacttcacccgtctcgtcacccagtcgtcgtaaacagcctcgcgtcgttcaaccaacgcgagctacttcatagcgtgcaggcgacgcgatcgtgccactcggagaaatgctgtgatgcacaccatcacatcgaagcacagacagcccaccaagctatcaccgcaccctcatcatcggggcttttgaaccatgccagcggagacaccacaagagcttgctatataacctaagactcccaaaggcgcataaaaagaatgaggcgagtacccatagccactgatccgcaccagcaaacaaccgtcagagagaactctagcaatatcaacgttttatcccagacccccgactctgtccaccatgcacttcagaatcgcactattggcattcgccgccgccgctactactcacgcggccctggacaagcaggccttcgcgtaccatgaggtcgaggcaagcaagatctttctccctggtggcggcgtcatcgacatccgtgtcccaggcggtgtccgagttttgagcagcgaggaagaggaggcaagcaagatcttccttccaggtggtggcgtcattgccatccagtacccaggtggcactcaagtctatggtctttgagagaacagaaggaagatctgactcgaaggtgggttttcgactaggagcatcaggttgcagccggaggcgaagctcccggatcatagcccacacgactgccaagatgccagattcttgacgccagatccgtccataaagaatacgatacaaaaataacctttatttgcagtaccggtccgacttgagcttttctctcctgtcgagtagcgcctctgagaatcgcccttccttcttagccgttttcaattcgccaatggcctcctcggatactacgacccggccatggttccatgtctggaacttgcgactatagttcatgtgaagagcagagttgagtatacacagtgcaagtaaaatggcagcataaaaaaaccttgcgcaaaaattgattatggcagtaacttcgatggagagcttacctctggtcaaactcgtagtctctggtggcgatcttgacctcagtggatttcttcgcctttttccggtgctgtgcctggatctttgcttgaaaggtctcgcagaatccaatcacctcagagtccgctctgatctggaatcctgttgtcgttcctctgccctccacagctgcaacctcgtccacactcagaaatttgccgtagtggctctgtagacaaatgccgccttcctcgtccgatttgatgactgcggtccattcttcctgcatgccgatcgcctctgtgtctgctgacactattccaaatttgtcagagctaaggtagcgaccgttgaaggccttgagtgttagccgatccgagtctgggatcatggttgcgacaaagacttgacgcactgctgatggctcggcgtgttcaaaaccgacgaggttgctgccgctggttccttcctctgcaggtgacccctcgaggggtcccatggagaccctgtctttttcgtcaatcatcaagcacgagggtggatccgaggagaaagtgagaaagatggggccgccgaggtcgcttagagtcttgacgggaacccaaccttgaaagtcgtgaaaccaatgcatgaacaaacatgagttaattcgctgccttcacgagtccagagaaagctgcaccaggtggagtcaagagaatagctgtagcgtaccttcggccttttcattcgagctctcctcctgggcgccgtcctcggcttttctctttttctttttgctacatgacgattccgaatgagtcagttgagaaattgagacgatggtgcgctgctttggcattagatcgggtatgcgccttgttggatgttgtttgcgagcactgagtaaccttacgtctttgtagagtcgcccttgaagctgagcttcttcttcttgacagtgtagtcgtctgccattgttgcctgcgaggttgtgaagcgaaaggagggatttttttgcgaagtgggggaggttcttggacacaatgaaagaagtctttgtaagtggcgtagcacacaggtattttctcctgccgtcgtctcaacctgaaccctctcgtcccttcccatgttgcatgagcttgcaaagaagcttcaactcatttgggccagccaggattccggtaggttgcacgatttcacgattctctacaggcgcgcagcatcccagcatcgaggcacccccagctcaccacccacgtggccttttaatttagacatcacggaagcctcctgcggacatgcagcgttcaggaccttactggaagccagggcgacattgacgacgtacctggaggcagactcaacttcgtcgagtgacctccgatccctcatacttcagtcagatgttttggtggaccatgcgcgtgagatgcttcatgcctacccgtaccgggaggtccctgcatgttggcgcgagttatacacggatgcagggattctgaaagcgctggctcttggcctcttcgactcttgctcaacaccagaggaatattcaacatccaacgccgaccctttaaagctggctattgcagcgtgtgataatgtattggtgatggccggggcttcgggagccggaagaaagtcatttgtgttcgagctcattgacgccttggaggaacggatcaatggcagagaggacgcgtctgaaccctcttcagcaaagcgacacaaaagtgcggcaacgaataaactaggcgaggagtcggatcagggtccgtttcccgagatcaagcaccccattcctcgagtacagttgccgactatggatgctttccagagacatgtccacggccagtcttctatgggcgaggcaacacccctcatcatcacaggagcaatagaccattggcctgcaaaggaacgatggacagacttggatacgctatgccggacagcaggacccgatcgcctagtcccgattgagattggaagccagtacacagacgatcagtggacgcagaagcttgtccctatgcgcgaattcatacagcaatacattgttcgggatgcagcatcacagtgcgcgaacagtaccagcgagcgacatcggtcgccgatcggatacctggcgcaacatgacttattcgaacagattcctcgactacggagagatatcgacattcctgactactgtctgattcaaccgcaggatcaggagggctaccatcctcccgacgatgtactactgaatgcgtggtttggtcctggcgggacggtgtcgccgatgcacacggatccgtaccacaatctgctggcacaggtagtcggtaggaagtacattcgcttgtatgcacctagggagacgccaaagctgtactgctacggatcgggatctttgacagacgcggacgggacggcaggtgaggagaacaaggaggcagccatgctcagcaacactagccaggtgaatgtggaacagccggatttagctcagcatcctttatttgccgacgcgcactatgtcgaaacaattctcgagcccggcgagctgatatatatacccttccagtggtggcattacatccggtccttgtccaccagcttctccgtcagcttctggttttgatgtgtgcggcaaaaagcgcctggcttgcacttgtcgcacaatgacagcagagtctcaccttgtatacttggggaaataaaccgattttttttacgcaagaacaggtccattggtccggcccattcgtaaaagacaccccgcgagccgagctactttgaatagagcatggcaaggaacgggaacccatgcaggtgctgacgaagcttgacagtgaatgagaatcaatgcaggtgttgacaaagcttggcaatgttcgacagtaaaaccaatgcaggtgttgaagaagctggacattgaacgagaaccaatgcctgtgttgacgacacgtgtcaaggagtgagaaccattgcaggtgttgagcaagggttaggaccctgttcataggaccagagctattttgtgccggttgcacgagacttgaactcaaaagtggcgtcgttctgtgacctcgtcccctctccgcttttctctgcttcatcgtttcgtgcgcactttcctctttttgctcttcgttcctctcgtcccgcctctcaaccaaacacactctccctgtcctccttcgctccctgctctacttcccttatactcacatacccacatacccacacactcttactcacacgctcacacacccacacttaacatcaaacgcaaaccatggtgcgcctctccctcaccgtctctgctgccttggtgctggtcgcctctgctgctgcacagaacgctgcctcgcactgggaactcgtcgatgcaaacgcaccccagaccaaggactttcagcctgcctgcggcaaggagttgcgcggtatctatgaggacctgtccatttacgctgtcccagcttcctgccaaatcaagtccagcatgttccctgctgagcagatgtactcacagctcaccgtcctcgaacgtcagcagctcgagggcgacactgaacagcatgtcgccgattggaacagaaaagtcaaggaggcagtggccgactttgctgtggagacgaacggcgacgttcctgaaaacagctctggccagcttccgttgtccaaccgccgtcagcgtcgcaagttctgccgcctcacaaccatcgacctgcccaagagccagccacggtcccgtatcctcgtcggatccaactgcgccgccgaagagacgaccaacctgattgactttttgccctccaacaccgagatcctgcccgtcagaacccagggctttgtcgctcccctcggcagcctgcccttgaatcacccaattctggagaagagcaggaccttgaaacaccgccaatcgctgcaggccattgtggaccaggtcgacgtcaaaaccatggaagaggatgtcacctggctctcgggcgaggccgagggcagccccttcattactcgcagctccacctcgaagcagagtttggaggttgcggagtggatcaagtcccagttcgagagctatggctgtcacacagtcgagctgatgcaataccagtcccgcttcgggcccaatgtcgtctggtacgtttttgcagtctccttgaagcttcacatagacacacgcacgcaggcacgcagcgtcatccacgggtgcaaagagcggcgatcggatggtggatgtggatgcaggggtcggcatcttgctgctgtttttctcttctttttttcatcaaaccaaatatggaggggaattcgagtgcctgaaattgcgttacgcacccccctctaacttacccttttatgtcgtccatgggtaactcggcactatgttcgccgcccacgtctgtagcacattcaagggaacggaacatcctgacgagcttgttattattggcgcacatcacgacagccgtggttccttcttgaaccctcgtgctcctggggccgacgacgatggctcgggctccagcatgctgctccaagtagcgcgactgatcaaagccaacaatctctcgttcggacgcacgcttattatctctgccttttctggagaaggtactgctacaccctctcgatgactggctgcgtggctggttatgttgaacacgattataatgtctcgtttctacttgtgaatgcataccatccagagcaaggcctgtttggatctgcggccttggccaagaagatgaaggcggacggcaaagttatcacgatgatgattcaaggagtaagcaaccttcgttgatgttggatctcccttgagattgctagtcgcgtgtcaacctttcacgttccactcatactgacgtgcctccatctctcattcaggatatgctggcctaccgtaagccgggcgagcccatccaggttgcattccctgctcgctaccatacccccgaggtcaccacactgttgcacaacgtgactgagctctatgtccctgaggctgtcgtgggcgttactggcgcctgctgctctgatcaccaggtatgactcgtatgcctaccgtatagtcttgtgcataaggtgcacttgggcgacgcgcactaaccccccccctgtttttcctgcattgtgcgaatagtcgttctgggaggcaggattcccagccacggcgttctttgagcgcaatggacctattgcggaccccaagtaccacaactctggtgatcttgtgtaccgcgagggctatgactttgcacagctgcgtgcgtcgaccaaggccatgctggcgtcggtctttgaggtggccgatgtcaagctgtgaggctgcaagtcgtatttactcgtgtcaaataatgagaattcaagatatatatatttttgcaaatgaacctcgcgtgctcctgcttttcttttctttttccctttgttcatttttctgattccaggtctgccttgcacctcctgtttcaaccccaccaccactgcgaccccctctttctccaatccttccgtccttccatccatccttcgctcctcgccatcctaaaatcctcttgtttctccgctgattccttcctcatccgcattctcgtcatcctcagcactctcgttccccatccttgacccccctttttcctctacgcgttctcgcgttcctttcttcgcagtaatccagccccgccccttccacagagcacaaccgcttgcaccatggctgtgtctcaggacggtgctccggcccaaagcgcctttgctgcaaaacgcgctgccaacgctgccgcagtcgctgccaacaaggccaaggccgccgcggcctccacagcctcagcgaccgttgcaaaagctaccaccgcccggacagcagccgcgtcggctacaaccgcaccagcaagggcagcagctacatcgacagcacgcacaagaactcccaccacagcaacaacgaccagcacagtagcaagagctacaacagccgcgactcctagatcgaaagctccaagtgcaacggcagcctctgtctcgagctctacagtagcagcagccggcggaagctccagggtcactgcaggagctcccgcgactgcctccaggacgacagctgccgtcaacaaacccagcgtgacgcccagctctactgcttcttcggcaaggaagcccgccactggagcaacagcaactacaacgactacagcgcctgcagctggaggtgcccgttccaggaccacaactgcatccactgcccataaaccaccggtgcctgcgacatccacgtccactgccagtaactcccgccaagtgccagcaactacgaccgcgaggaccacgaccaccatccgcatcccacccggacagacggatggaaaaccaccggctgtcggaggcaggccttcccctaacatgactcaaacatcgattcgcaccacctctacgcccgcgccctcgtccaagaccaccaactcctcgaactcggctggacctgttgcgagaaccaggccggggagtgtcaccccagtcgcctcaaggactggtgctgcaacaccggcaaatcgggcagggtctgcgacatccacaacaactcgctcacgctccgtaacgacgacactcacgcctgcgactatcagcggagcggtgaagcgagttggcggaccgggcgcaccatcgcctgctgggagtgtgcgctccgttaggaccgctgccacagcaccgactagtcctatggagctgaagaaggctattgccagcgttcgcaccaaggtaagatcgatcggaccaagaacattcgggtatttgttgacaagtacagtatggatgtttatgagattggaaagagtactaatctgaagaaatcaatgtatcatttttagctcgaggaagcgtcagtgcgactcaagaagaaagaagaagaactggcggtgctgagagagcaactggagattgaatcttgcttggaaacggtaacaggaacggacactgcgtcgagcgatggtggcgagactgttgtgccagagatggatctttccaaactgccagagcaggtatggttttttaacatttcttcaaggacatgtgccatgaaggcccagactcgtctcctcacgcaacatgcactaaaaaaaaaaggaaagggatgcatatctaattttactcgcttgccctttcgataatgcgaccggaaactttaggacaaggatattgttgtagccgccatagcagccaaggaaaaggaggtcgccaaaaagaagcatcagctcaggtcactgaaggctcgagtggaggtaagttctgcctactggcattatgccgctatgttctcagtacgccaccacatcactggtggctaatttcttttttgctgggtatctatctacatagcgtctgcgtcgggagtatgagcaaaccatcaaggatctgattcaagagcaccacgaacaaaaggcgggccaggatgccaggctggcttcactacgccaggaactggacgaggcgtttgaaaagcatgccaacaccaccgcaccgctccgccagaagttggatgaatccctagcccttcacgccaccacgcttgaccagctgagcagaattcatgatgacaagctacactgtctcgaactcgaactgcaggcagccacggcagaccagttgggacgtgctgatgtcgccgatcacgaagttcaggagcgctatcgcctggatctggaggatatcaagcagacgcaccagcaagaagttgaacagctgctccgtgagcatcaggaagaggtcgacgccgtgaatgcaaactttgaagtcctaaagaaacaggctactgaggagtacgaggtaagttgtgtgtcgtagttattcatggctaacctcatcatccagagtttctgaagattcacccgttgtcctgattctcgttgttaggcagagttgcgggaacgattagattcagagctggcacagatcagtgcttcgcacgcgtcacagctcgacgatcggaagggcgccgatggtggaatgattgagatgctgcaagagcgacatgtccgtgcattgagcgagctgactgtgaaagctgagaaggaacacagcatgtacttgaacacgcttcagaacaagcaaaaagccgagatctccaatctcgtgagcaagcacaaggatcgatccgtcgagctcgagaacaggatcaagaaactgaaggcgaagcatgagagcgatatggaggccatgaaagcaaaggcagacgcggatgctaagaagctgaagcagaagcacgcatcggcgatcacaaagcacaaggaagagcatgcaaagaaactcaagactgtggaggggtcgaccaaggtaacgactatgcttttgggctgagttatcagatttttaagctactcttacacctagttgcagtgactcaccctgattgtctgactcgataatgttaggacaatatgcagcgtgaactggatgcggtgcagaagcagttttcgacctttgtaggagagacacagggcactctggactcggcgatgaggactctagaaggtggatacgagacgaggatcgcagaattgattgtgactcacgagaatcgtgtccaggaactggagaatgcagctaacgagcaagttcaggaggctctggagagggtcgagactgaatttgagagtgatcaggagcgactgaaggcagagcacgtccagagaatggacgaattgaaggcccgacatgaagctgctgttgaggatctggaagatcgactctcaaaggccgaggaggaagccaagaaggcagttgagacgaccaagaaactgaaggcagatcaggagatggcgttgaaggagtcgagagccgatctggaggcacagctcaatgcagtgttgatcgcgatcgaggagcaagagtccaatcacaagtctggccaaggtggattggaggtaaaattatctttctagatttttggtgcttattgcaagacgcgtcacgagaatgcagtccactcacacttatcatcgataactatagacactcaaggccgagagtgcagcctcaatcgccgccaagaccacagcgaacgaaaaggcatttaagactgcagtctccaaaaaggaagccgcttggcagacgaagcaggataagaaggccaaggagatccaaaccatacgcactcgactcacggccacgcagtcggaagccgacaaagcccgtaggaccctgaataacaaggagacgcgtttgaaaacggttcgtgcatggttgcatttttctgttccaataggaccttcgaaatgaatacgaccctgaccatgtatcttgttctttgattgtcgcgccataggcacatagcaagaccctcgaggccaagacgaaggaacacgccgcggcacttgagatggctcaaaagcgtggcgagacgcggttgtcggatctgagaaagactcatgagcggcacgccaacgctcatgagggcaagctcgcagacttggtgtctggccataaccagcagctggaggccattcaagaaaagcaggaggctttgctgaaggcccgagacgaagccaacaagaaccgcatcatggctctgcagcaacgcgtcgaggctctcaaagcccagtctggctcgacatcaatcagattggctcaggacctggaacagaccgtcaaggctctggcggagctgaaggtgcagaacgaagtcttgaaggacgagaatgagcagctggtcaccatgttggaccaactgcaggacgccatggtgacccgcgcttaaaaccactggcgaatatccaaaccgttacccgacccttcatgcgatctcggcggacctctttataccttatacccatctccctccacatccttcagcttcctcaacatcacttcatacatacggagggacgctcttctttttcattttactttttttttttgctcaaaactgtttgtctagtaacaaaaacgatggctagatgaactttcaagctcccccttacaacgccttcagcgcatgtccgccgagcggaatggctcttttttcttgtatcccgttacaatttttttctctatgactgaaaggccgtggccttggggtaccactctgcagcctttgccttgaactcttgcaaccgacttgaccgcatggtcttcaacgttttcagagccaggatgcagttctcgagcgatcgggttcttttgtactttgcatcgtccgccatgacgaacaaaatctcctcagccttggccttctcgttgggatggatcaaggagacggcaatggcggccgagatgaggtgagggactgagcccaagtccttgttcttgttcaaaaaagacgtcgtgaacgatgaaagatcggagcccttgttttcgtaaagagtattccagtgcttgtcgatcacggtcttgacagcaggcttgacagagtcgccggccttttggacagcgagcgcgaaccggacgagctgctcatggagcgtcgcgttattggcatccaactgcgccgacttgagcagggccttgagagccaagagcagcttgtctatggttatggagagaaaaatatcctgtgaggacgtgctgctgaacgaaaactggctcatatcaatgtcgatgagatggagggagggcggacttactcttgcggatataaatctcaaagctcatgaggtgcgtctcgatcctttcggaggccagttcctgaaggggtttcaggaacttgagtgcctcggcgagaggatcctcggccttcaggtacttgacgccctcaggatcgtcatcgaccttgccgcccttcttggagatctcctgcacagcctgggccttcttttcctcggcctccttctgagccttcagttcggccttgcgttgcttgttgcgcaacttcttcttctcaccctccgtcatgccctccatctcctctgtgtcggcgccctcgggtttgtcgaacaggctcacgtagcacttgacggcattttgggctgcgcgcacaaagtaggggtgcgagcgcagttgatcctccagcttcagtagtctgcatgatggtgaaagcaaggcgaggagatcactgttagcaaaggagataacgtcgctctttcctcagggcaacagggccataaagatcatccaccgaaagagcgcacggtctctggacacttacgaaatgtaagccctcaaggtcatcttgcgcaggcagtacatgtgaaagtcgaattgatcctctgtaaagtcggcaaagtgctaatgagttgcgaaaacgtaagatcagtttctctaggcgaaaaaaatcgtctgcgaccaacaacaaaaacgcgtcccaagttccggtctccaggtaccttttccacctgatggaagcgcttcagagcacggccaagctgtccctgtcgcagatggctctctccgctctcaagtgagaaccacatcgcctgcatatccaccagatcgttcagaggatccgcaatgtctgcgcgagcaaagagcacgaccgtcttctcagcctcggccatcttgtcggcgcgaagcatgtactttgaacacttggagttgatgaaacggtcctgcaagtccaattcgcgagcctcgttcaacgccacggtggctgcagccagatcgcctgcgtgcttcaagatgcgtccctttgtcatatggagctcgacaagggtgggcgtgtgctcaatggcacggttgatgtgatctagagcctgagccgtctcgcgcttaaagtcgaaatgctgtgccaggaaatacagcgtccacaaaagggccgtgggtggttcgacagtcgaccctgatcaagagaacgaaaccggggcgttagagaaaaacaagcttacagaggattgccggacaatcgattcgatgcaagtacggtcgcgcctaccagagtgatcaaaacctttcgacttgtccagggccgagagatatccaagggcgagtttctcgacagcggcctctttctccttgtccgtgtaaagagtcttgatgttcacaaacaaggagggcacgcctttgcggagcatgttgcggaggtactcatctgccactctcacaaacacatctccggtggcgtagcggaggggcaagcgctttgccacattcgaacgagggtattccttctgcagctgctggaacatgtccagaaccttagcctgatcctcagcgctgaggttgtcgtcgcccaatcccaagctcttgcgaagaccatccatgtacgcatagttgtcggggttggtggcaatcaaggctctgtacgcagcctcggcctcctcctgacgtccaagtgccaacaaaaaccttgcgcgactctccttgacggccttgcgatcgcagacatgcttctcaatggtctccaggtgctccagcgcagcttggatatcgcctgcgtcctcgagcattgagttgtggtacaacaacatctcgctgtgctcatagtctggcttcgaaggcaactcctgcaggaaacaaaagaaagtgggaacgggttgatcagcaacctacgacctttttcatccgtttggacttgttggacgccatcctctgaatttcggcttcctgttctcaccttgagagtctcctcgtaggtggtgaggaccttgacgccgagatcgggcttgcccatcatgtggtagccgatggctaacccgatccagaactgcctgttctggggtctgagctcgagcaattggtggcgagtgtctgcgaacgcctcgaagttcctcgtgtggatctgaagcagagagtagtcccgcatgatctggaggttctcctgtaaagagcgcgcaagtggcaacgaacgatcatcaagaccagtcaagggttgtgagacaaaactcgatgtcatagtcaatgtggtcatgcagttgcccgctaccgtcgctttccgcggaaacgcatagatgtatgtaccttgtcgatcttgagtgcctgagagtagcacttcagtgcttcctcatagttcttgtccgagcggtacaagagtccaaagacgtgccagcctatgaaacgaatcggtaagttgacggacaagatcgcaagtaccggaagccatctcctgatcaaaacacgtctcctgatccacttacagacatggctcctcagatcatggcggagacccttcttgacaaactcgtaggcttcctccttcttgtccaggtggttcaggaacaaacccttcagggccatggtctctacacgaaacccccagaaagaaagaaagaaaagggcgagcggaaggatagtgcaaacctcgtaagtgatctgtgtcggtctgttggagcgcgtctacgagtacggtctcgtccactgatgtcccactcacctccatgctcggggaactttttcagaatttgctctgatcctttgaggcccttcttgtactgcttattctcgtagcatttctaacgggaattcgagaaaaatatgggttgatcagatcctgcagcaaccttgtctctccagaatgcatgcactcggattcctgttgagttcctaccaagatctgcttgaacaagttggcttccttctgtggcaattccctcatgatctgtcaaggtggagcatttcccgaggacaagagaagatagattgaggagcatggtggaggggggttagaaaatgctgatccaggtcacacaccgccgcatgcccgtttctcggctggagctcgaccgatggttgctgctgggcaataggaaggtccacttttacctgctgtgcttcgtctcgcctgcgatggtgattaagttgagtcgtaagttgaacctcaaagctcaggacggggaagtgtgcagtcaagtttgacgcacgctgaggtgtgcgctcatgaattcaaagccacctcaacacggtccatttcgcacctccacctggcacagcgggaggggggggggacgcgtctgccgtctctgattatattcacgcgtttttttttttgattttttttaagcgttccgccccactcgtcctccatcttttcctaggtaactaggaatagtacactcagtaatacgaaatagaatctaggaggatacacttcgtgcagtggctcagaagacgcaaaaaaaagagcgccgttggccgacgttgggtgctcctcggtagtgcctgtatcaggaggcgcttcgttcctgaattagatgagaatagaacgctgtctctgacatctgccatatgcgtctcaaaggcaaggagaggcagaggcactcctagcgaggaccctcacccccatgtctactgatcgcgacaaggcattttttttggtgcctgttcaggagcatgtgagcacaaggagaaatggacccatgggtctactggcgcaggaacaagtctgctgaacagagaatgaaagaaaaagaagaatgtgcaccggaaatgaacactaaagttggaagggagtttctttgaatgatgtttccaacttaacatcccttccagtgctactaatctccttgtttttttcgacttattacctagcagccatcatgatgcccgctcgggcagcaaatgagcgaaaaaaaatctcctgtgctaatgcgttgtcatgcagaaataaatgaggcgccagtagcggcgtaattgcgctcgcggaacacggggaccaggcgccttttttttgaagaggaggaggaggagggtcaagctcaactgaatggctccccccctccttaccgtatggattagagcaaggggacgccgtagacaaccgacagctcctggcccagctcaatttggataggagcacccgtttgtaaaccgcttcgtctaggcatatgtcctcgaaatcatgctaaatttgtcacagctcgtatccaatctccttgggcgaaaagatctagggaggcagagagagtggaactaaacctgagtactctgggacgagcgtccacattgtgggtcccttgattgcttttgtgcttggcacctgcccttgcccttcactcaaccactcttactccccttgtggtctgcgccaatcggacaataaagcattctcgcaaaagaaaaaacaaatcgcggcggttctgagtgctcagccctcgagacgccaaaaaaaaaaatggggggagggagtaggccaaagagctgagtgcacggacaaatacgcagaatcagccagtcagacaggcagacagacaggcagaccgtcagacaaacaaaatcatgcatgtcatgacagtgtgatgagccatcaccaagcactgttctgggtaggggagcagaatagggtcgagagatctgggcgccaacatacgtagaatttcaagaggcgatttttgtgttcaggggataaaaaaaaagcgaaaacaacgcaacaccagagaacagggacacagaagtgaatcagtgcgtcggcctttggatgtcctgcgtctcagcaagagtgttctttgtgactaatgcgatggcaacacaaagagtcaacagtctagtcaaggccactgtgaggtgagagggagcgggtagactagggggggggggggtcaggaagggagagggaggaagagttggacgggtgggtcgagtcaacagagatcgaccgtatcacagacctatcatcagtcctggctaaatgcctcttctagactctgaggttggacgagaactgggggctggccttgcgaccaccccttttctaaacctgcccagcaccacgatcgatcgattagaaagccacgagtcgccgtcggatatgacctgggtgccatttgcatggtgagggattggaaggcgacaattcaacagccgacagggtggacgatcgcgtccgcgctagaccgcgcaatcatgctgcagacctgacctcccgtcttgaatatgtttcttctttttcttgccgcctcgctaccgtcccttgcccacggctattgtcacaaatcgatcctgcctgacttcactgccgccgtccatggctagtgatggctagtgtggtgaataggactgtgccggagagaagctggtaaagacgttctcaagcgagtgcgccttctcgtgagactctctctggactccccctcccgcccgctgcacgcttttttatcactcagaatccatacttttcatggataaagactaggatactcgtggttcttgtttccaaggatttggggcaggttcatccgcttgacggccatggaattgcgaatagcgacgctgccaaagcgtgctcttcattgatgatctctcccttgacttcatcgccaatgatgtctctcgttctctcgcccactcgagagatctccttgaaagcgaattttggggttggacccaggataagagaatcaggacactctggtccaaccgtggcctgagcgaagagaggcgaacgagaaggttgctgtttctcgccccttgaatcagttccaatatgacagcggcaggcatttgcacaagagtgatagaaattatattgtctcccttttgatgatatgcagtctgttattcaatcgttgtctgcatgtcctttcctccattgtcttctctattttcaccttttcactctcgaactctttcgcagctcgtgctccctgcacatgtgctctgtttagactcgctatatattcgggaggacatacaataagaacctttggaggagcaggcgtagcttcagttctgcctctactccacaacgccaattgttttgttggtgccggtggtcaggatgggccgctctatgccagtgggccacacactctcctttcccctcgtcctttttacgctgcaaacaacgataggcagatgaggggcgtcttgaaccttgatgattgcgcgtttccttgtgcgctatcctcgctcatacagcacaggacagagcaggatggagctcagaagagggagtgagaggggtccgaccattgcgtctatgcgccttctttgtatcggcgttctctgcatacatacacagatatatctcttcaggtaaaacgcacgagaggaaacgaggacgcggtgccgttgatccaagcagtactataaatgcccgcaccggttgcccaatctcgcacattttttcgtctatccttcactgccagcagcatcatcctcaacggccctctctccaccatcatcaccattactcgcacacccttcccttgcgtatcgttcctctcgctacattaataatacctccgacggccggcattcatcctcatcttccctttttcccaagcgttagtctgtccttcagatctgctacgtctaccatcggaacctctcattgcacggttcagcacgatccaccaaagtacgccccacccatgctctcgcctgtcacactctacaggctcccgaccctgccattttcatttcagccctttgttcccatcatgcaacagcatcctctatatactggccttttttttttgcttacttacaggagcgggcgcttgaccatataaatacccagtgaaaagcaagggcgatacccacaatcattttgctcaattgcttctcaccgttctccagaagtccttttgttgttcctggtttgctcagctgcttcttgacctggtctaaccgccccgtgcccctcccccaaaaagctcacaacggcatcaacgtttttggtttttttttatcctccgtgtggaccaccctattccatcaagcacgcctctacccccgtcttctcccctgcaaacatagcaaacagttttaattgtaccttgcatcaatctgtcaaggaacagacatttaaaaagagttcttgacccctctccccgatctcaccgttgcgcctcactgcctccatccactaccgcccctctgcctatggtcacccgctacttcctatcctctaacactcccttattctttcactcacgcacccatcagtcaacaacccttctcaatcacaccacagcatagtcgatcacagccatgtctgaatcaaaatcggtcaatcctctctcctactcggacttccggagcgatacctgtaagtggggacgttgggatgtacgtcttgctgcgcggaaccgtcttggctgtgtactaacctttcggatgatatcttttgatcatttaagcaaccgctccaacacccgaaatgtttgtggccatgatgaagtcctcgctcggagacgatgtttatgatgaggacgactcagtcaagaagcttgagaactatgttgccacgctatgcggccatgaagctgcactcttctgctcctccggaactatggtaacgaacataattgcatttgcattatctcagatttggccattcatgcaggaaaaaaaaaaagggggggggtggtgagggaagggaggtgagggaagggaggtgaggtgagggaggggtgaaagagaaggtggtctaacggatgtaacgcattccttctgcccacttctgcataatgcccatccatttgtaatacaacattgtctaacgttttcttctgtgatggcctccttctcctcctcccgccgcccacccccttcgtttcctaacagacaaatcaattagcccatcgcgtccacctgaacaaccctcctcaatcagccattgttgatattcggtcccatgtcttcaattacgaggcaggcggcatctcattccattctcaggctgctgtataccctatcacacccgaaaacggcaggtacctcacggtcgacgatattgcctcgcgcctggtcctcgatgtcgatgtccactacgcccccacccgtgtcgtctcgctcgagaacacgctgaacggcaccatcatgcccatcgacgaaatcgagcgcatccgggctctgacgcaagaacataacatcaaactccatctcgatggtgcacggctctggcacgccagtatcgcgaccggtatctccttgaaggagtactgcagccatttcgacaccatctccctctgcctttccaagggcatcggtgcaccgatcggctccatcctcgtcggcaacaaggtcagcatcaagaaggcgcgtcatttccgtctgctctttggcggtggttggcgccaagccggcatcctggccgaggccgctctctgggggatcaatacgaactggccaacgatggccgacacccaccgacgggccaaatggctcgaacgcgtgcttttgcaggtcggctgtcaaatcacccatcctgtcgacactaacatggtctgggtcgacaccaccgatgcaggcttcaccgtggacgatttgattgtcgagctggccaaagagaatatcaagatcagcggcagtgggttcgcagcacgcattgtgttgcattatcagatcacagatgaggccgtcgaacggtttattgaggtcttgcgcaagatggcgtgcaccccacggatgaagatctcggtcgatctcacccgagccgcgatgcgttcacaaccgagtagtatctatgaggaacaacccaacacgcccagtagtcctgttgtgggccagcaggtctcccgccagcaacagcagcaactgtcatccctgtcacccaggcaacagctctcgaatacggcctccatggtttctgaaccgacatcggtcgatcaagacgaggacgagcttccacagcgtctgaactctctcaacatcaagcgttgtctctttgaggaccatgcctccgatcctgaacccgtatttgctgtccatgaactgtcacaagagcccctcgcattcgtcaatcgtcagttgcgccgcgggaccaaaagctgtgcctctcaagaacgtcccatgagtgcctacgaacccgagatgatgctgatcaaagtgcgcgaatacgagcaactcgaggcacttcaaaaactacacggtcatcgcaacagccagttgattcaatctacatccgccaccactatcgctacacaggcggacgcgatccttcgaggtgggaaggcgggtatgggacttcgaagcacacagtccttggattttcaagagtttgaggctcgcgctttggtcagtcaattgtcggatcgacctcagaccgccgtcgacaagaagaaattaggccacaagttccagcaccggctatctcagaaccctgctagcaaggcctttaagcgtgccagcacccggttcgtccgctggggcgcgatcctcaacaaagaggcttaagaaaatccctgcccactcccactctagattcttttttgtttttctttttgtgtgctttgctttgctttacttcgcttttgcttttttaccccctcttctctgcccttgccttttcatgatccccactcctgacgagatggtgctacacagtaataaaaaaaaaagttaccgtttcaatacataccagagtactgctcttctcacatcgcgatcgaaggatgggcttgtgctcctcaatttgggcgtcggtaggagggttcatgtcccgaccaattttttttttcgtgtttgggtcatccgttctccaacccgattttttttgcatgaacgctgcagggggggggggggggggaggcgtccctagcccaacggataaaggcgccatggacatgtatacctgctggttctcatgcaaacataagcactaaacaaaacataagaaaatcgacgcatgccatgcaagctgcaaacgtgtgcagagtacatgtagcgggtggatctgaggtgcaaaccgatgtgtatgacgcgagaggtatgtgaggtgcggtctagaagaggccctcaaaagcagcagcaacatcaataaacacaggaacaacaacacagtcaggaacaaaacggcgcctgctaggcacttcatctcgtccaatcagtttgcggtcagagcagggtgccttcatgagttagagctgtaaaacgttcaaagtaaaacacaatctgtcgcgcttcgccgctatcctctcctgctgccccgtcccccgtccctctggcccccctcggccctcgtcactggcgttcattttttccgctgttgtcacgaattcctccaagccttgttgacagagtaaagagagggaaaaggggagaaggctttgtttcatctcgatcaacgcgaccattgcgtggggcactgcgcagggaccacgacagaaattttaggggcgcgaggagcttcatccgcaggcgttgacccaaagaataagcgacgcttactttttgtatcgaatattccttgacagattctgtcgcagtggtagatatcgcgtgcatgcgtgtagtagtgtacaatacggcctagatcgattactgtctttcagggtgtgaaggccgttttttttttcttctcacaagcaggtcttgcactccttgtcatgcacagtcgaatcctctgcatcatcgtctacagccgcactactgggtgctgccgaggtctctggtaggtgggtggtgaccgatgatgttgctggctccgactttgttgccgcatcgctgttcgtcttgccaacctctgctgatttaacggctgtgtcactgtggccgagtcccatatcgggtgcgatcaccgtccgaaccaactgcttcacctccttcatctctggaaaccttccgtggtccttgcgatcaaacaccgacactataggtttggtatatcgtagttatcacaagagagtgagagaggtttaacggcgagttgatattgaaaaggacaagatcaaaaaaaaaaaaagaagccgagatcccactgcgcatagtcagcgctgtctgtacataccgccattgactcggacaataaaaatcgcgctcttgccgggaatgagcgccagttcgccgatggtgtttccgaacgtaagaagcaactcctgtgccatccatcctgctcgaagatgcctgccattgcgaaaaaaacagacatgcgacatgcatgagtgctctgcgatgaattcttcgtttcagtcaaggcaccttgaatgcaattgctgtgttttagcctgtttgttcactgtaccacttgcatccagtgcagaactcaatctcgactcggggatggtgggtttcgatggcagccattattgcagcgaggtgggtggtgattgcttgtattactgggggtgtttccaagtcgctttcggtgcgtgtgtgagctgcaacggtgtccgagagaagagcagcgagcgactgttgatggtggtgtgtgaagaggcaagggagcaagtgtgaaaggcaggaaggaagaaagagagaagcgacgcacgacgatagcgagacatgtgcatacgccgtgctcgaggaccacagatcggagccaatgataggcgcgcgatggcgagcttccaggcgctggactctgggcgaaatcttcgattggctggaagtggtgtgccgctgtcgtcccttttatttcgcctcgtcgtgtgcgtacaggaagaccttgaagtcgtcgtacagaatgtttccgtccacgtcgtaatggaacacatcatagcattcctcgcaaaagtagctgggtgtctcgcccgcaagacggtcgtcaatcgtgatgtaaaacgctgggttggtgttgcacatcctgcagcaatgccggatctgcttgctcttgaagacgggctttggatacgacaggcggttctgatcatcgtatcgatggctaaagagtctagatagtcatggggtaccaaaagcaatgggtcaaagtcatgactctctgcacacctgcgcacacacaatccaacaaagtcatcaccctgtctaacctcaagtctcggaatatcaagagatgttcgcagttgccctggtgcacgagcaaatatggatggttaatccgaacggagaggtcctggatcagcgtgtcgtgcatatgtttcttgcgaagattggcaaagtccgggtcaagcttgcgttcagggttgctggcgacccagtctatgatgactctacattaagataggacacatggggtgttagcaaggtcgcgaacaaaagtaccacagtcaagagcaacgctgcatgaagcaatggtagccctacttactggccataatcatgcgaggctgaagcatagaggtgctcatcctttagcttgatctgctcaatcggaatatcctgacgacctgtctgggccatttgtttcagaagctccgcgttgtccaagtcctcctcctcgacctcattcctatgagcagcaccctggacaggtttcctcgagaccccctttcccttcgatctttcttttgactttgctgatgcttccttacgcctcaactcacgttcttttaccaagccctccaaccgcttccgctccttctcctgtagctcgttccgcttgtcgatctttgccctcgacagtggtgtgtctgtgtaaaaggtcccttcgatataaatgaatgagttgctgatctttttgttagatttgttcttgacgggcgagtcctgctgctcctccgcgccctggttgacaaaatctgataggcaatggaatgcatcacgcatggccgtcagaggttggctaccaaggaacaaaaactcctgggtcctcttggtagggttcaaagagctgtaaagcgccacagacacgatcgtctctggacctaggataggcacataaggcatgctaaagcgcggcggtcctggaccaacgtagttcataggcggacgtagctccaccggcacctcgaaccgatttctttccgccaagctttgcagagaagagtcttcgactgccatggactgagcatggaaccggtcttccagagaagtggtcccgacgcgctcctcctcctcgatgcgttttctttcggacgcttccaaaacgacgttgaggtcatcctggtcagttctttgagctggtgctaagttgctcgtccgtgagtttgtctgctctgcagttttcctggtgttgagttcgtcagtggtcgatatagggtcattagctactaggtggtcggatgatggtatatgggacgagttttcggtcgaggttgatgctgaagttgatgctgctgctgatactgatgctgttgttgatactgacgatgacgctgatgctgtcgctgatgcatgaacaggttctgacgcggatccggtcaccgaggctggttcagaggtgctttctctgtcctgagtgatcgattcctgctgtccgtctttcttcttggctgcaggcgcaatatcccagggtcgtccccatttggtacgcatctgtcgcggttttggctcttccaggaacagtttcttcctcctctcggctcctatcctcacccggaaccgatccgagttactcataactcgccttcttctgcctcgaacagacgcgcccaacagtctctgcacattctcgtctcccaaacccggtggccgtgggtgctccttcagatgtaggttggaccggtcgccaaattccgtcacttcgtccacctgtccgtatatagagctccaggtaggacgcagagtcttgtcgatggggtctttgctttcctcgagtcggccttcataccattcctgaagcagtccacggagagtggggtcgtcaaagaacttgttggcgtcttgaaggtcatcccagacgtcgcagcgcttggcgacttcctgctcttgctcgtagtcgtcaaagtattcgtggtagccgtcgtgctcgcgctggtcgtcaacgaggcgggtgtagttgagcccaaatggcaagattgggaagagaggtccctggggcgcaacattaatgatggacgtcaccgtctcgtccgacagctgtcccgaggttcctgactgttgacgattctgtgcccgtggtcgtgatgagctgctggaggccgcgtggctcatggtgaacggattcgcgttcgggtcaaaaaaaaaaaggcaaaaaaaaagagtgtggtgaatgaaggatttgaatcggtggggacttcaaaaagcagagggttgaccaaaatattggctccatcagcgcaatggcagtcacgagaggtatatgatatacattattattacactgcaatggaggatggtcggttcaagtcctaatacgcttgtggccactctcttgatgccaactcatcgaggacgaggctgctgaggaggaccatggctcatctgtttcgggatccgtttgctgttgctcttcagctgagccatctgcgacctgcacactgctcgacggtgccgatcgcttattcgatgatgttcctggtgcgttggacaacgtctcggctgccatcttctctgccgccttctctgcagcactcaaatgcgtgcgcctatgtcgtgtgacttgatctggccgcgaaaatcgcttctcacagccagggtgagggcattgaaagggtcgctcacccgtgtgaacgcgcagatgcttggtcaagttcgaggactctgcgaaccacttgtcgcatccttcgaatttgcacttgaaaggtttctcgcccgtgtggacccgtcggtgaatcgtcagtgctcccgagattgaaaactcgcgcccgcaacctggttccggacatctgaatggcttctctcctgtgtgtgttcgcatgtgctgcgccatgatgttcgcctctgagaacctcttgcgacagagctggcactggtaaggcttgtcgccagtatgggtctgaatgtgccgcattgctttctgtctctgcccaaacccgcggccgttcctttcgcagccctcccactcacacatgtactcgctcttgcctgtaccgatatgatcctcactcagatggcatgtgagtgagtcaaagttgggaaacgacttgtgacatcccttccatcggcataaatgttgttcttcctctgatccactgtcctgttgagccgcagcagtggccaatgtgagtttgctggcactctggtcccttcccggtactgattttgttctggtttcagggcgcaaaacctcggtctctggagatgctggcacaatgtggtgatctgctcgcaggtgctgtaaaagtttgttgctatccaactgctccgttgcacaggattcccaaagacagagagcgtggtcattctgaggcaggggaacatgtagctgtgacacatgcggaaggagatcatcctgggacataaactctgcggtgcatcctgtccagagacagcgaatcatgtggtctatctgggcgtcgttcatggcctctgtcgacattaaaactggagacgaggccattggcgatgcagagagcgaagctattgcagagacactggaggatgtatcgtggaaatgtccgtggttatggccatgactttgagcttgatggtggctgctgtggttgtgattgtgattgtggctatggtggaagtgggtgccgccggtgctcgaggtgtccaaaaagtggaaagcagagtgggcgtggttgtcgttatgattacaagcgtcaatgacactccacctagacagttccaggcagacaggaacaaagaggagtgagctaccacagtcgatgatggtacgatgatcaacaacagcaaacgatatcatctgcttgaacttacggctgagtaagcggtgggcatggcaagggctggacggagaagtagtgtgacgagtgaagcagtgcgttcggtgttggagtggaagagacagacccagacgcagagcttggggactgtgtgagagtgtcgggacagcaggtcaggcaacaatcatccagcacctctggatgctctgtgcaacaggtggctgcgatgggcgggggaatctcgttgccgggctgacaacaagtcgagtccatgccgtccttggcggccgattcaatgatgcaacactcgacctgctgcagagtgaagccgttgatcgatggctgtccattagacccgtcgcagcagtccagggtgtcgagctgaggtccgcagcaggagcttggctcgacggttgagcagcaaaagtcgctaacatcatgggtgagggtgcagcactcgtccacaacggctgccgatgtcattgtggaggagagaagtgtctgtgtagtgttgtgcgagggaaggagggagtaagtaattgtaaataggaaggagagtgcgagaatggagcgagagtgaccgagaacgaggaagggcaggaagcaagggctaatgtgctggcggtgtatagagcaggcagaggcagaacattaaaaaaaaaaaaaaatgaagacggtttgtttctccgcaagaggtttgggcagttgttggtttcgtgaaccagtgttcgttccgcttgggaaattgcaccctactggatatggtctggggccactggtgtggacagcgatcaacatgaagctgctgctgcactgtgatccactctatcgccatgaaggacaatagagccagggtttgcagtacgggggggtcttggtccaaccttcttgctggatgaaaaaaggctgtcgacgagacgacgagaacagccagccaggggtgaataactctttcaggagaccatggctagccgcgatggaacgtagtttacttgtgcatgcaacctagtttttagagagtgctctggctacagaagtgtttgtatcatcagcggcgcatcattgggcgattaccacgtcgatccaagcttccacttaggtacaccaagcagaagatcacattgataaggaaattcaggtggatcagcatggggctggctctggtggcgaatgtctgctttgtctcatgatccctgtggctggaccttgacgcagctctccagctacttgtggagactgtatgcgaggacgctcaatgcggaagcagtcgatggtcgaagttgtggtggatccaagatccaacgttgacaagaggaatgatatcggacaacagagatagtctgcgactgcacagccatatcgaccaagtgtggagagtgtggaatgggtgagatcgagagtggaatgagaacattggagtaattcaatgttctgtagacagcacatcccctccacacgctcgcgggaacgaaggagccagcgaaactgcagatcgatgatgggcccgggctgggtgcgagagcaagggcacagtggagctatcgcgctgtgtgttgactgctctgcgtctgatcgatgagtatgacccatatgatgtgtccgccagggccagcaggccaatggcagagcgcggcctctgctggctgaactttgatctcccccgttcggactaatttcaccgcgagataaaaagggctcgtgttttccgagtctcgtcctctctttcctctcccctgcccaccccttacccgcgctctttctcgctcctcccgcatcttctagctctatctggtcctgcttgcttagttgctctccctccctccctccttctctctctctgctggctcgttgtgcttcattcataaccacccctttccattcacacgctcatacattgacatcatgtcgacatttctctctgctgcagcgtcacaggtcgctggccaagtcaaaatgcaagtatccgcctgctttccgaggccttctcatgcggcgatatggcgtcaggcggctacgctaaccagttcggtctcgatgacgatccactttactagtcatgccaaatcctccgcaagagcggctgtggctcagtgccaccgttactcgacaggatctcgtagttcgtcaaaacccgaactcaacaagttcagttccaagatcacgcagccaaagtcgcagggtgcatcccaagctatgtgtaggttcttatatgagcaaactcgatgacagcttcgaccatgagtaccaccaccaccaccaccaccaccaccaccacgcgatactgacaacacaacgcgtggtctcgatcttcttttttcttcgggggtaatagtgtatgccactggactgaaagagaccgatatgagcaaagcccaagttggtatctctagtgtgtaagtgcatctgccgtgaccgaagcaaaatgttcatgaaagagccagataccgagggtgacatggatgactcaacacgaactttctggctctcaaatatgcggttgacgatagctggtacgaaggaaacccctgcaacatgcacttgatggatcttgctgccaaggtcaaggaaggtgtccaggccgctggactcgtgggctaccgcttcaacacgatcggagtcagcgacggtatctctatgggcacagcaggcatgagctactctcttcagagcagagacatcattgcggactcgattgagacggtgagtttcaaatataaccttcttactctgttgcacatgacaatttggtgcgatttgacagtccgtttgaccaaacaggaccgaggaacgcgggcggccaatgagatgagatgagacagagatctgtgtttgctaaactctgctcctgcttgttcgaataacctatgcaggtcatgagcggtcaatggtatgacgccaacatctcgctgccaggatgtgacaagaacatgcccggatgcctcatcgccatgggccgtgtcaaccgcccgtcgctgatggtctatggaggcacgatcaagcccggcaagtctgcttgcagccagggaacactcgatatcgtctctgccttccagtcctacggatcttaccttgccggaaccatcaccgagactcagcgccaggacattgtccgcaactcttgccccggtgcaggagcttgcggtggcatgtacaccgccaacaccagtacgttgttctgaaagactaacctgtgtctcatcctttcgcggctgtctgaagcgagatatgaaaaactcacaccctttgcgtctattttatcttgatcatagtggcatccgccatcgaggccatgggaatgactctgccctacagctcctccactcccgcagaataccctgagaagcttcaggagtgtcttgatgctggaaaggctatccgcaatttgctggagctcgatatcaagcctcgtgacatcatgacccgcgaggcctttgagaacgccatggttttgaccatgatccttggaggttctaccaacgccgtccttcacttgattgctatcgctcgctctgtgaacgtcaacctcaccatcgatgacttccagaatgtcagctctcgtgtcccgttcttggccgatctcaagccctctggaaagtatgtcatggaggatgtgcaccgcatcggaggaactcccgcagtgctcaagtaccttctcgacaatggtctcattcacggagactgcttgactgtgaccggaaagacccttgccgagaacctgaagaacgttccaggattgttggagggccaggatgtcatctaccccctctcgaaccccatcaagcctactggacacttgtgcattcttaagggtaaccttgccccacttggatcggtcgcaaagatcactggaaaggagggtctcttctttgagggtcctgccaacgtgtacgaccatgagtccgacatgttgcgcggccttgagactggtgagatcaagaagggccaggtcattatcattcgttactctggacccaagggaggccctggaatgcccgagatgttgacgcccacctctgccatcatgggagccggtctcggaaacgatgttgctctgttgacggacggtcgcttctctggcggaagccacggattcattattggccacatcactcccgaggcccaggagggaggacccattggattgatcaagaacggagatattgtgtccattgatgccgacaacaagaccatcgacgtcaagatcactgacgaggagatgtctgctcgtcgctctgcctgggtcgctcctccttacaaggccacccgcggtaccttgtacaagtacatcaagaccgtcaagaacgccagtgaaggatgcgtcactgacgagtagagagttcattcatttcaataacaagcacctgtaattttaccatacaatcggagaagttgtgctgttgctgtccatgtttcttttatacgtgtactacttttgctttcttggtacctctctcagaactctccagggcggcgccttcaagttcgattgcgtgcttgctgtccacagaatcttgcgcggcggcctcctcagcatcgttgtcaggatcgcggtatgttggctgaggaagtccaagatgatcagcgaacagaactccccttaacagctcggccacaacccatacgttcaagctgttaccgagcaacttgtaccgctgtaaggccttcaacttttctgggaactttaaaaatggccccgaggcgttctgtgtctgtcgtggattgaatggtctagtggttgtgagtgttgactggcttggttctggcgcttgatccttccgctcggacgcatcgtcttgctggtcgccctcgagaggaaagacgtgcaagcgggccacttcggttggggtaaagaagcgcaagtttagctccgcaatggattccgagtctccaaagtcgtattcctgctgatccatttttgaggtctggagcaaaccgccgccactggcgacatggtggctcccgtatgctttcgtaaaacaggacgatctgttggatgacgggcggagaatatctatatggcagaattgacaaaagaaaaatgagtgggtgagctcggttttcaacccatggacgggttagctcccaatatcctctttggtacgttgccgacctgcttaccgaagcgaaagttgggtcgctcaaggatcagttgccttgatagcaaatagtcctttgctgcagtctcgtcttggtccagaaatttctcaagggttggtgtatcgaaaggatgttgtttaacagatgtttctggatcctctacgaacgctgggaacggccatgtcgtgtaaacggtttccgtatcgggattgaaaggttctgtctccgttttggatgctggggatgaagctggctgctcgaaactcgatctcagtcttgccatcagaaagtagcgaagtcggtcgttgggcactccaaagttgtagggtgcgagtagacattccctgaaaacgtatcccatcttgtgaagcagcgtcaccagcctctccctcgagcgagatgtctattgccagtaggcacaaaaagcgtcagatggttgcaggtagcttcgttcagtcatcccacctcgtggctctgtctatcggccaagagtcgactgtgaggatagctacctcaaagttcttgacgttttccagaaagagataggtgggtggtgttgccatcttttcgagctgatccagcagatggagcaggggcttggcccggttatcctgatcatccagcagtttgcctccgcgggtgtagggctagtgcaagattcggaattgctgcgttcgttagagagccaaaacaccgatctgatctagagctatgtgcctagggctgtgattagagagggcttgtttacctgacacggtggactcattagccagcagtttgccttgtatctaagagtcgctaagatgacgcgtcattaacgcccaagtcctgactcgtaggatgctgcttcatgatctgaaccccataggcgcaatgtattacttttcgatatctttgaccgtcagccgatcgatgcctctctgtggttgttggaagaaagcggtgttgggcgaaagggtaagcaagtgccgaactagctctggtcagcagtgcctcagcccagaaagcatgctgtgtacttacagagacaggggactttccgaagcttagtttgtatgtctcgttagcctgctggttcatatcgaagctctcgaggaccgatccttcgatgccgctcgcgttgaagccaaagtgctgttgtcgcgttttggagtaatgacgagaaagctgcgttaggaagcgggaagacgacctccattatccatcccctgcaaaaacacccattgcaagcacggaccagtcctccgattccactaaagaactcgagcgctctgatctgtgacatggtcccgagtagagtgattctgttctgcagtcaggaagtgaaaagtgagtctcgctgcgactttagtgtagccattttttggtccgttgcagcactcacaccgaatatctgcctcagtgacgtcgtcatggaaccagaaaatttttttgtgggtcgccctcaaaagcggttctgccccaggcgtttgtttgttccaccctttctctcttcaacaaatctatcgacatgtctgaagttactgaccttgccatcggaatcgatctcgggtatgtccagccgccccttttcctgcctcctctcagtccacgatacctcaggaaccagtgctgcagcaagcaaggaggatacagttgtgtctcaacacagtccatcggaatattgaatctcgtcaggatccaacttgcagcctcaggggcagccaacggacccaaaaaaaaaacacaaaagcaatttcaggattcaaaaacattacctgtcttcagatccggatcagagtgtcaatgacctctcccaaacggacccgatcagatccacgttggatcgactaccctggattccggatcacatcctgtcttggtggtggaggattcgattatatatgtgactcagaatcgctgcattggtgtttgagcactttctcccactacagcatggatcccgatatcgacaatcaccaggacctggttttttgctcaggagcacacatatcaagaacgctctttgttcctcaggggtacttgcctctgtagctcgcagtagtactgactctcttgtcatgttacctttcatagtaccacctactcctgcgttgccgtctgggagagcgagcgtgttgagatcattgctaacgagcagggtaaccgtaccactccttcgtacgttgccttctccgagcaggagcgtctcatcggtgatgccgccaagaaccaggctgccatgaaccccaccaacaccgttttcgatgccaagcgtcttatcggtcgccgtttcgatgaccccgaggtcaagtctgacatgaagcactggcccttcaccgtcattgacaaggagtctgcccccttcatccaggttgactaccagggcgagaagaaggagttctccccccaggagatctctgccatggtccttgtcaagatgaaggagattgctgaggccaagctcggcaagaccgtcaccaaggccgtcatcaccgtccccgcctacttcaacgatgcccagcgtcacgccaccaaggatgccggtgccattgctggtctcgatgttctccgtatcatcaacgagcccactgccgctgccatcgcttacggtttggactccaaggagaccaaggagaagaacgtcctcatcttcgatttgggtggtggaacgttcgatgtctctctcttgaccatcaccggaggtgttttcgccgtcaaggccaccgctggtgacacccatttgggaggtgaggatttcgatcagaccctcttggagcacttcaaggaggagttcaagcgcaagcacaagaaggacatctctggtgatgcccgtgccacccgccgtctccgtaccgcctgcgagcgtgccaagcgcaccttgtcttccttggcccagaccaccatcgaggtcgactctctctttgacggtgtcgatttccaggccaacatcacccgtgcccgtttcgaggagatcaactcggttcacttcaacaacaccattgagcccgtcaagaaggtcctcaaggatgccaagtacgccaagaaggaggtcgatgagatcgttcttgtcggaggttccacccgtatccccaagatccagtctctcctccaggagttctttgacggaaaggagttgaacaagtccatcaaccccgatgaggctgttgcctacggtgctgccgtccaggccgctgtcttgaccaaccaggccggtaacgccaagacccaggacctcttgcttttggatgtcgtccccctgtccctcggagttgagatgcagggtggtgtcatggccgttgttgttccccgtaacactgccatccccaccatcaagaagaagaccttcaccaccaccgaggatggtcagaccaccgtccagttccccgtctacgagggtgagcgtcccatgacccgcgacaacaacttgctcggcaagttcgagctctctggcattgcccccatgccccgcggcacccccgagctcgagtgcacattcgagttggatgccaacggtatcctcaaggtcaccgccatggacaaggccactggtcgcaaggccaacatcaccatctccaacggtgccggtcgtctctctgctgccgatatcgagcgcatggtcaacgaggccgagaagttcaaggatgaggacaagaagaacgaggagattgtccagtccaagcaggagctcgagcactacgtctaccagatccaggacaccctcggacagcccaacgttgccatgaagatgaagcgtggtgacaagaaggccgtcgaggatgctcttgaggaggccatggctgctctccagatcgaggagctcgccgagaaggacaccttcgtcctcgcccagcgcaagctcaagcgttccgtcaccaaggctttcgctgctttgtcccgttaagaacttttttttattctcttaaagtaaaagttgtttttgttaatcgtccatcacaccccccttcatggcttcctcagctactcttttgactgcttgcttgctccttcgcttgcaatcttcttgtataccatgcatatgtccctgaaagtgcctgtgcgtagatggttttttttttttgtgtcaagggaggtcggtcgtacacaaaatcgtgagagaagcaaccacaaggacaactggaatgtgatcgattgttgttcctcccaaaacgtctatttttttttggcgatactgcacccttttctctcttcaattgctcatcttgatcgacagttggccatgatgactccttgaaaacaagacaaaaaaaagggacttggaaaaccgaactctggtttccctttctttcttttttctttctcagactgagaggcaatttggccaagaggcaggatcatgaaaataaaaaaaataaaacgcagtcgtttatgccattgaaaaaagatgttattactggcttcggaactatgttacagattccacaacactcgcaacagtcaagtgagcggcagacgacaagaagcccgagtgtagagcaaagaaatcttgttgcttcatcgcaaaagctgcgcgtaggggcgagtacgcgcgagagttagagagtgtgtgtgtatgagagagagggcgagtggatagaaagggaatgactcagagttgaaaagaaaccagcttgttcatctgatcgtcgtcgcagaccgagggcatcatccagggggagagcgagcccgaacggcgattggcggtgggatgaccgccaccactactactgccgctactactgctgctgctattcgtcaccgtcaagaaggggtccgagacatgaacagcctctggcgtcgtcggtctggaggaggtcggtgtgcccacggcggtggacggaagactgcaagtgcccatggtggtagcgcttgtattggaggccgtgcggatcatgcgggacatggttgcgaacatggtggactttgcagaggacgaggacgagccggcactcggtgccaacagtccagggaagagatgggtggtccttgcggcagcggtcgctgtggctgtggaggacgaggaggaggtcaaggatggtattgacgacgtctcggtcaccagcgagggtggttgtgatgaagcaggatccagggcagagaagggttttgagccggtgctattgcagccttgacgggcacgaaagtgaatggaagggtcggcgacgtcgagtagaaacgacatgttgtggactgtggaatgattggtggtagtttttttttttctgggttctttgggtgatcgagcgaatgaccaggagaagcgaggctgtgtaggtgtgtgcgtgtatggtgtcccggtgtgtctatgggtgagtgagtgggtctatgctggctgtctaccgtctatgtgcgtgctcgctgctctggcttgtaggattgggaaagggaaaggggtggaatgggtggaatggatgcaaaccgttcgagtatttaaaaaaaaagttttctgaacactctgcggcgaataagatcggtcggtgcccccttcgtttttgcctcattccggctatagctatttttggcccagaaacagcgctggtccgctcgtgggtggcgacacgggcttgggagcaaggtgtggatgagccctttcagcagtaattactgtacaggacagtagacactctacggagacggtcaggagtgagctaccaacaaacaaaacccctcacatggagaaccaaacacgttgtccctggatggttcgccgagagaaccaaacaacagcaactgttaagaagatattgctcttcttttacaaaggagtcatgggaacatcatgcccgcagcctctagacacgctgttgtttcccttacctggccaccactccacatggttgggaacgggctagagaaagacaaccgctaaagtccacgcgcgctctcgctgtttgggagagagcaaacaggtttatggactctcgaacaggcagaccaatccgccgatgccgggatacacagtcccttgctcgggggccttgatcattactgcaaaacagcgcattgagggacatttcatgaggcagtttaacaccaaagaagcgatagggtgcccctgaggtttcgtatactcggatgctcctcttgccttgagaggttcactctcactagatgggtaccgcgcaccagtcaacgttaacatattcagtccattctactcttaacacatattgcccgctgttcgggccccaacgtcctccttttttaccaaggagacccttctccccccttgacaattagttgaagaagcaccggacacaaaaagtgccgaggactttactttgtcccacacgcacgcatcatagtcttattttccttttcttggtgaagatattcaagatcttaatcatctacgaaatgatgcaacagcacgtccgagagcacgacctttcgttggagacatattcttctacatgctttgcgtttgccttggcactctccaaccgatcctctcgctcctctagtgcgtcctgttcgctgctgctagagtcctctgactgcgagaccgcgtgattcacacccccataagaagaatgtcgcaaggttccagaaaccacatccttttgttgctgcgaggacaccccaggcgctggatggctattccaaagaagccatagcccttcgtctgcttcctcctgtcctccttgtatatcctccgtgtctggctctgcctgctcgtgtaggaactgtgaatggggttctatgacatctagtgcgaggaaaaaaggtctcacataagcaataggggacggtgtgcggattctccggatgcaaggcacaacgtcttcacgcttgcatacgaacgttggagtgtttctcctttcccttcgttaccttctcgcttccgcgcactggtccgctctgacttctttttaagactttccaactttgcctcttgcaatggtaatggtaaaaataacaaagagtcaatcggggagtgagcgagtgtcgtgttgggcgtccatgatcgtcaaaagtgcacgagcagtcctggcaagccagttaagctagtcaagtcaagtcaagtcaagtcagaacaagtcgttgactaaccaaggcgctccacatgaaggtctgattcagactttagtgtccattgtggagctttagtggaggcagacgattcgaattcaggccaggctgcggatgatgacattgtgggaagaagctgaaacgttgcctgtcataaatttaaagtttctttgtgcaacagccatgtctgacctgattgcagatttttttctcgtccttgttcattctttacaaaagatgcaatgtgtgagtatgtatatgagcgtgatgggcggaattgagctatgatacagtttgaaaatgagggggaggagtatgagagggtatggatggtagaaaggatgagggcactacacatgataacaaaaaaaagaacaatgctcgctaaagtttttcctaacgcctgttgtcgtcagagatgggtggtttttgagcacagatcaccttcatgatgagctccgcgttttcggcaacgcactccatcttcatcaggctgatggtctcttcaaacatgccgtcctcgagccggttcatctcgatgatctcctctctcaaagactctacgagcgacaggtacgaccgcatcgcaatcgctccccttcgaccaccccaatcgccgagcggaatgccgtattcgtagcattccacgttgatgagtcccgcgcctaggatagtcggcatcagagcctccaccatctgcattgggttcagtccagagctcagagcggccttctctacccatcggttgaccttcaaggactcgattccagcgcgtacaatcattccgctcgactctgccagctgtatccatcctccgggcctcgtgaggcgtcccagctctgcaaaatgaggtgtccattccatgatctgggtcctgaaggctcccaggcgctgatggaccagatcgaactggccttcctggtccttgacgtctctcagtttgaaatggcaattctctggcactcgttgcggtaggcgagccacgtcgagcaaaggatccactgcgtagacaatagtttttgggtatcgcaaggccatatcctaaaaaattgaccaacgtagagagagagagagagagagagagacgtactgtcagtcaagctgaggaagggcgcggctgttttgaaagcgtagtggcaatgaatcgagtgcgaatctacttcttaccatggcccatgcgcctgacgaacagttgatgtcgattgccttgcggaaagactttccgataggcgccatgaggtcgagttcgaaggtgatgcggtccacatagtacgggctagatagatatcgatatgtcagagaatgaaatggcgttaagaaggtcgcgtcaggtgtgctcgtggtttgattttgattaggctttgatcgagcggtctttacctctcagaacgaccttgttcatcgccaacgacgggtataatccagccagggatattggtgtttgggttgaaagtgagtgctccgatgacatcatccatccagctgtaaattcgttctcgcttaacattgtctctaggattcgtcggattttgcttgctcagaagggcaaatacttgatcaacgacaggcactcggatcgcagaagttggtggtgttgactcaacaagaggccctgcatgggcaaaggcgtctagcgcccgcggcaaggatgaggacccgctcgccagcgccgcgtgtggctgcgcgttgttgccatggctcatgttgccaccatgggttgggtagccatactcattcctcttacgcgattccggattcgtctgtgtctgtccactcgactgctgttggtggtagctattctgagtcgggttatttacgtgatggctgctgctctgtccgttgtatggataagctgaagggtgggaggcatacgctgtttccgtatagtcccgctgtggctgcttcattttctgctgtcgcactgaactgtccttcatggccgatggcgctaacgaaaggccagcctctgcaagtgcatttggggtcgattgtgctggaccgttggacatgttctggaacgcaaacggggaaaaggtcgtcgaatggtatcctgaggcattgcagaattgctgctgctgcggtgcactcgaggccagcgatgggtgctgcgatgggtgttgagcatagttattcggtgcgcgtccctgtgagggacgccttacagagatacaaggtcgcgcatcgctctcttctcgctgttgaaagaccatctcttgaatgcctgcagcagtcccgctatatcctgcaccgccgccgctcatatctcccgtgggcatgctcagcaatgcagcgcgcgagggcacccctgtgcctcgcaaaggtatgctctgaatcatcgagtcatggttactgcttggattgtaagagcttgcctgtgtcgcgttcatggagctgatggggttgtttgtcaccgctcctgacgctactgtgcctgagcctggatctatagcgagaatcgtcccgcctccgccaatggcgcttgtggccgctgttctcttgactcgagaaccatactgatgctgcagtcttgaatccgaagatgagtggtgctggtgctgatctaggcgtgctgtattcaaggcgtgcgtgtggaaagatccgacggcatagtcagggcgggtagcagttgcaggacccatagatccttgaagagagtaatgtccactgtcattgggcgcgctatggccatggaaggggaccgaattactgcctttgctggaaaataggttgcagttgctgctccttgacctgtgcttcttttcctgctttcgggagagtccacctggatgggcgcggcgggagatgatgtttcccattgacccccaacactagagctgccgggttgatggcttgttgtgctggctggaaaaccgcttgctccgtggggttgaatgtagggtgtgtagtcctgatactatgccacgaacagtagtaactgttttcttcactttttttcgcagttcgcgtgttcctgcttacgaggttagtcgctggaagagagttagaacagaaagagggagttaagtctaggaacaaggcgcaggtgcagtcggggtgatgaaataagcagtagcgataaaaggcccactgtatcgagatttccttgaactacaagaacacttaccattaaccaggatgatcaaggccaggaagggatgtggaggatatccaacggttgcaaccaagcggaaagtgagcgttagcgcggtctgtatcaggaagtgtggggtacgcgccaacgtgttgtttgtcgcttgagagccaacagtgaggtgcgagaatgagcagaaagaggcaaacgcgagattgaaatggcgtctttttgtggaaatgagcaaaaagccaagcagaatgcggcaatgacagacacgagtaacaaaaggtaaccaggtagcgagaacgaagcagaggagagaaagtaacagagacagggagagagtgtgcgggagagagagagagattaagataaagagagagagaaagagagaaagagaaaggtcagaagggcttttgcacagagataacgcgaggagaccgtacggacgtgtcgagcgcggggatgctgtcaaggacgagccaactaaaggcacatggacagctgcggacgagcctcaacgaaccaacggacataccccggggaggtctgttgcacgcttgcagctttcaagacgaacaagacgaggaggcggagccgcgattaggaggaagaggacgcagaggacgaggagaagaagaagaaggaggaggaggaaaaagaggaaagcgagatattaacgacggatggagagagaggacgacgagagaacgagaagagagggatgaggagagggagagcacaaggaaaaaggacaaaagcacaaaaggacaaaaggacaaaaggacaaaaggaaaggagagagaccgactcgcagacacacagacacacacacaaaaaagggaccgtaacgcagcctcatttacgcaaatgacggactcgcaaagctgcagaggtggaaaagcgcatcaagaaaaagtctaaactaggcgcaacagggcacaccgcacatcgcacatcgcacaccgctcctcttttcgccacaccaccgacgcgctgagacgctacatgtacacgcgggtggtacatggccatggacgctacacaaaaagcgtttaaggttttgtttgttcgccctcctcgtctgtttcttgtgggcgagccagcaagcaacgttggccgttcaccgcagctagtgctggaccctcccttcgtcccgacctcatctcgcctactcgccgagcttttacagatcacaatctcctctttttctttgttattacagtgtcctatagtgctcccttgggcaacatttgtcttttgcctcctgcccttgaacgcatccttacggtccggtcatcgttgcacacccttccctctcctcggctttgcctactggtttattttgaagggaattaattcagacgtcggcatgcaagggcaggacgccgcaggaagggagcgcaatattttgtattcagctcttcagctcctcggccctccgttcattgtatctctcaactccacagcactactccacagcaccagagagtccaagaaccaagggcgcatgggagcgataaacagccgaaccaagcaaagacacccaaccactcctctgctgccaagcgtcacttgccagcgagatgtccttctttagatttaagtcagcctacggacctgatcatccagagatctccagcaccaaggctgcgcacaccagagggagaggcagcccttccccctagattgctggtggacctgaatctggacaatcatgttacaacgatgcagtgccttgcacagtaccaaatgtaccacattggtccatagactgctgttaccccctccttaggcgcatgcacgactctgtcatggaggcgaagatggatgcaagcacccttcaagacaatccccctacatcgcaaatagatacatggatagcctgcaggaagggctaagggggtcttttagaaagaccgcgtgagtgtgatcgggcaattttgttactttggcatatactgcgaaaaaagtcacgggatttaaactctgcgattcaacgttttggccatgcaagatccatccctcagcaccgaccccagtcaagcaacaatgcttcacaacgcccaattactcaagcaaggagccgaggctgtacgttttggaatctaacctctagtgaagacccatagtttctgggggatggaccagcgaaatgaacacctgcaggaaagaggcaaaacgcatactcaactcgatccgaaattcctcttcgcatcccccgtggaccctatagaaagtgtacttggcgccgttctgccagcgccaggccatcatcaaggagcggttcgcaaaggaatatcgacacccaaccttggacaagaaacttacatccaggcgagtcatccaggtatgggccgcatgtctaacgcgtgcgtatcttggacactttacaagccctgcggaattccttatgatgatcttcttacgagagagtttgttgcaacataggaagcaagatgtctaaacaggtgccaaaaggccctgatcgataccccaactgtctacatggtcgacgtagccaactcgctcatctacatggaatacattgaaggatcgtccgtccgggactatctcgtcacttcagaaggacaggccgctgaggctcaaaccaaggtcgcaagtcttatcgggaaagccttgggactgatgcacaatatcgacgttatccacggagatctgacgacctccaacttgttgatgcggcaggaaactgggtccgtggtcttgattgacttcggactcagctacgtcagtcagttgatcgaggacaaagcagtggatctctacgtgcttgagcgagccttttcgagcacacatcccaacacagaggttatggtaaggattgttggatcttccttgctgctgtgagtccaatatctgacggtccctcctcaccagagtcaaaatctgacatttttcatttcctcattggctttagtttgaccagattcttgaggcgtatggtcaaagcagcaaagcctccaagcagattctcaagaagttggaagatggtaagtatcctgttctcagtgtgcactcgtaccaatgtcccctccacaaatggtctgctgctaactccgccatccctattgaaaaaaaaactgccattcttattagtgcgtatgagaggtcgaaagcgcagcatgctgggataggaggacgggatccgtattgaataaagggcgccctctgccttgcaactgatatcactgaggccgaaggagcgttgtaattttattgtacagtgagaaaggaggttgctagagtctttttgtttcctgattcctcaattccatgaggatcatttcctcaatggttcggtcagcgtacttaaagagcctcttcccttatccaaatgttgtcgaaggggttgatattccatttggtccctttttttcgccacctagaaagagtgatccactggtctatggggtctgattttgctgtgtctcggttgcatgagagggtgaagctgtgccagatatgtgatcgcccacctgttggaagataaaaagatgcaattaaagagtcagcgtggagacccgccatttgcgttgagtacgacggttcctgagagaggtggtttcttacatcaagtagcatgagacaaacgtcataatcaatgcagtgcggacgacactattacagtacgagcgaggccagcagtgtcagtcaagatattcacgggcggttttcgcttttgcctcagttgtccaaagacgagaactgctcaaagaaggcgggctgcttgttgtagagacgttaggcgcgtgtttgaagagagacatggggtccatttacgtttggttagggccacgaggagcgaagaggtaggaggccgcgcataaggcgacgacaacagccaagacaaaaaagattaagagaccgcccatggttgctgtttgctggttgtcgcttgctgtggaggttgaggtgagcggtgagtgatggaggttgaaagagatagggggtcgcatgccgtcgttcacgcggcacgaaatagacgcctgtgactggtgaagcgcaacgtagagacgtcactgttttcgatggcgaagatctcacctcccaaaggatcagcacaggcgttcagccaacaccacaccaccgacgacgaaaatcaagagcaacatcccaagcacacaaacgaacaacaatactcctataacagctcaaatcccggcaacacaacaatgtcccgaaggaaacaagtaccaaccgacattctgaccgaattgccagagcttgaagaaggccagcggttcgcaagagtgctaggcagtcgaggaaagaacattcacgaggttcagtttcaaaatggagaggagctgctggtcaaccttccaccaaagttcaggagtcttgtctgggtcaaacgaggtataccacttttcgaatatctggacaaggaagcattttttttttggcctccttctacttctggcaggcggtgatatggctgatccactcttcgggcgcagtgcatttctaactccttctgatacctgtggtctttataggaagctatgtcatcatcgagccagcagaggaagcagacaaaaccaaggtggaaggcgatattgtcgcagtcctctttccggatcacatcaaaaaatacaaacagcaagggatttggccattcgaggatcaactttcaaactcgctaggaaacgacgacgaggagagcgggagcgatggcgatgacaacggcgatgatgacgaggatgatgatgatctcttcgtaaacaacaaccgggtcgtcatcgaagagtccgacactgacagcgaaagcgaggacgacaccgacgaggaaaacgacaagtaaagtttttgtccagtcaacatcttcaatacacttatcaacaaacgcatcatagacctcccagcattatatccgcattctcttataaagtattcctttcgacacagcactgtttatgaggcattctacgtggctctatcaatagcggcgttttactggcgccaatttcgtcaaatgcgaactattcgacctcggtccccgaagctcgtcaaaatatggatgcagtagcgctaacgcaaggagaaaaagaaggaggcagcaagttaggatcaaacaacatcaggttcgtcgaaagttcacaggatgcaggtgtagagatcatagccggactgcagcatgagcttgttacctctcttggccgagatccggcttgctgggttatattcgatcatctgttcaagcaagtcaagccctgcggggcacaaggtcggaagcagttgactcagaggtacacggtcccattgcggaaagtttgggttccagtccttcagatgctccaccccaggccatgtagtcggatttggcgttcctctaatcttgaagatcctgaacagttcatcaatctcagaatcacctaaaatacacgaagaagttgttaatgtctatcacgccgacgggagatcgaccttcaacgggaagattagcagaacggtacctggaaagagaggctttttggtgatcatctccgaaaatatacatcccacactccacatgtccactgccgtcgaataatgccttgcgcccaagagaatctctggagcacggtaccagagcgtgatgacttcgtgggtataggtcctcagagggatgccgaatgcacgcgccaacccaaaatctgccaacttgaggtgcctcttatcgtcaataagcaggttttggggtttaagatctcgatgaagaatgcgtctagagtggcagaactcgactccttggatcaactggtacaaatatctctgtagagaaggacatatcggggaatcgcacgaactaatcagctactgagggcggtcgttttgtggcgaaagtagagtcttagtccaaacagagccagccttcgccttaccttgacatgatgcaatggtagtcctgtgcccgtagcagtgtagacgttgtccatgtacttcttcagatccacgtctagaaactcaaatacgaggaacagtttcgcctcatcctgaatgatatcgagtagtctaccagggcatagaagccgggtgagttcgcttgcacaaacaagttgttggccagctagcaaatgagccgttgaaatctcaaggcacgattgtgaatgaagacttttccaagacttactgaacaatagagctgtgctggagttctttgaggagcgagatttctctaatggctgtacttggtacgccttgaaggaggttcccatgagtttgcagtgagttgggcgcgaaagtgagtgcaagctatgtctcaggcacaccgcatgcagtctgacactgcaatgccagtctcgcaatccttaccctcgtcttcattctccagtcggatctttttcagcgcaaccgtcctccccgtttccctttcgctattacaagcgtgcaaacaaacagtgaaaggcgtgggaatgagtcaggttgagagtgtctgccattagagtgagtactgctcgcatgggaaggctgaggaaaaacgagtgccatgttgctggcgaaggatggaggtcactatggaattgtgtaatgctgcactcacattgctttgtagacaacgccataggtgccctcgccaatcttttccatcttttgatacttctcgttcagaggatcagtcttttccttgggttgctcctcgccctgaggcatctgaccaacctgaccattcagagcgtcggccttcattgtgatgaatagagtaaatgagggtatgggatggttgatgtatgctgtattggtgcaggaaatgacagggtactggggagagaaatagcaacgctgtgatggattgggtgtgctgtctgcaagacgaagggtgttgctgctgaagaaaggagtcaaaagacgcgtctgttttcgttttcaaataaaaacgcagtcgtttgttaatgcccactattgtagtctatatttttacaagtccttcttcgtcccagtcctctgattcttcttcacgcccttggagggggcagatgctttagcgggagcagcagcgcgctctctctcgcgcttgttgtagatttcggtcgtgaagggtctaatcggttgagttacaagccaaacgcaaaggcaaatgccgtcgttagctcaatatccttccatcctcctgtcagcagcgcaagttcgacagtcacttgcttacccctcgaacttcaaggcaatacgatagacaaagtatacgatgcacgtcaagtatactccagcagggcttagagacctaaaagatgccggccaagagaagggatcagcacttcagcgagatgacgacagcaagctcagttgcaatccttgtaacgtcaaaaccgtcgcatatgacataccacagagcagttcccaggaagatcatcacggtgccattgtacatggggttgtcgttgacgttgaaggggaaggaggttacccgctcatccatgagaataccaaagtagtcgcctatgtagatcagaatgattaggctcaaagtgagcgaagacgcgagatctcgcaaggctgcagggcaactcgggttgatctcactgaggtctatagcgcttaccaagataggtgccagtaacaccaaggacatacatggacgagagaacaaaaaggtttccaactccaaaaaagacataagccagcgcctgaatagcgaatgtgttcatgcactctgccttgggctggtgatccactgcatttttaaagctatccacgttcgacaagtgttcgagcaaagggggtcagttgactcaatccagcgcctcatgagcagaactacgaccgcacgcatatcttccaaaaaagagtgagtgatggtataaaggggggattgataatcttacagagcgtcgcggaccagaccgagaatgaaaatggtggcggccagggcgtagcatccatacaacccgttcccgttgaacatgcgagtgatgaactttgagcggtactctacagaacatgatgtacatcgccatatcgcggaagaaaaaaataagcagagcacagacatttcagttagtgctccgagcgatgtgcatcctgtggtcaggaagcaacgtggcatccgtcgtgtttaaggcaacaacattacgaagaagcccgaacgttttgattgctcaccttttcttgcaacgatgttccagaaggtggggttgaagacaatggacccgacggcaatccacatgcgcttgtcgctccagtcgacctcaaggcgcgaatctctgtagcactgcaagacgtccatgatgaatccggttagctgatggcaagagttggaagggacgaaacgggaaagggagggctcggtgagagttcaagggaagggaatggattcttgaggaaaagcacgcgggaagcaagagttttttatgggggacagacacggccagctgaaagtgcgctggaacttttttttttctctatcaggcgcgcgcgtccccacagaaaaaaaaaaagtcacgtgaaactgttttaattgtctaattgttatttgctcagttggaatcctgtgcacgctgatcggcatacgttccgacaattttaacgtccaagcagaacttgcctagctcggcagtgacatcgctcatggtcttgctgtccccgtggattcctgcacactcaacaaagaagacgtagtgccatggcctcaacaaggaagggcgcgagtcgatcttggtcaagttcagactgtagtccttgaaaaccttcagtgcatcacagagagctccaggcaaacggtgatccactgtgaacataagcaaagccttgtcgttgcttgtgggtgcatcccaggcgtccgagatgataaagaaacgtgtggtattgtctaaaacaaccaaatccccgttaatacgagggtttaaagtacacgcgatgcaagcaatgacgttgatggtactcgcatatcacaacgtaccatgttgatcctcaatatccgcatggagaacatcgagaccgtaaatctcggcacaaacattgttgcacacagcggccgcgtacttttccttggaagcgatctgagctgcttccgaggttgatgaacatggaacgagctcaatgcccttcagtttgtcgttcaagaaagtctggcactgagccaaagcctacaaaagttccagaggttaaaagttgtctagccatcctgcaaagccataaaacattgcatagttagcgcgcctactcaccacaggatgggaataaacacggcgaacggcgtcaatgttggagttcgaaagcagagaatggtgaaccggcaggtagatttcggctctgatcttgacctttgacttgacaaacttatccagcgtgggcaccacggagcctgcaatggaattttcaaagggcacgacaccgtactgacagcggcctcgctccacagcctcgaaaacgtcggagattgagccctgagaagcatactgcacactgtcaccaaatctcttcgtgctggcctaccaatggaaatcagttaatttgcgattcactgcaatcgatcatgcagtgaggagtacgagcactatggcgccttacttcgtgggagaaactaccgacgggtccaaggtatgcgaccatgacctccttttgaagcgcgatcgacgcagacataatctctctatagatggcgcacaggctctctggcgccatcgggcctgggttcaggcgcgccacctgcagaagaatagtttctagtctatcagatctcaatgctcacgcacagtgcttatcaagaataaaaaacctctttaccttttcaaaaacctgcttttcgcggccgggaatatagacatgcgtgttgtcctcttctctgcgttgcgatgggcaaatgaggccatgagttttctgacaggctccattgttcagagaggtgactgaggcacttactcagggtccatggcctgctttttggcggcgccgatgtcgaggctgacctgagctcgctcattgagcaaggtgatgagcttgcggtcgagcgaatcgatttgcagacgaagagtgtcgagattgagcgccatttgaagcgatcgagcaaggtgagggcgaggagactgggtgggtggaacgaagaacagagatgggtggaacgaagaacagagatgggtgaaaagtgtatgcctttttaaagacgacgtttgactcactcgctggatgacatccagcccaccgctgcagcagtcacctatacgagtgtctcaggagttgcgctgtcctaccttcattcgcacaagtacttcaagtaccaagcatatacatatacaacactcgtccgatgaacgagagaacaccaggtaaacagagggagacgccttcttccaacgatctcatggatagagtggagaggatgtttatccaggtgccttgcgatctcgagccagtgtcgatagaactccattggccacagcaaaaaaaaattgctatttttgggggaaccacggacgttgcttctttgtctccaatctcaaccagctccaccatcgttgcgctctttacatcttgaactcgagccacaaattgcagctcactcctcaccctcgcccctcgtcccacctgactccaatacacacacaaggacctctggtcgggcatgtgggcccttcacgggagaagcgcattcgtgcaactcaccacaaatgcatgcaagcattcgacacagcggttgcagcaacccctgcagacacaggcgcctgtactacgcaaaatagctgggtctaggggctttcaccactgtagtcctttcacagacgccgcagcaacacgacgtggattgcctctcaagcagattctcttgcgaccgaaaagtacctttactggaacatcacaggaagtctcggcgcaaggtatcttcaacacgcctggtttgctaaagcgacggatcaagcagggattttgggtcgggcttggactcggcacgctggcttcagccgtgggtatcgcctggagtccttcttatcgcgagcaggccaatctttacactgctggattgttccgatcggtggcgaccttcgtcacagggtaagaaaatggtgatcggtcgagaaagattcagcatgccgcacaaagcattttttgatgctcatacgtgcatgtctttgtccaggtgcttatgtatggcagactacaaggttcttcacttgcgatacgcttccgaagggtatacctcggacacttacaaggctgagcgaaaagtagttcatcaacgatgcgcagacagactgctgcgactctgtcggctcaacactggaatttattgcaaggcaggacagcacgttggtaagattgtagacgatcccgaaccgatcacatttgatcgttcatctcgcacagacgtagacactggacactaacttttgcttttttacgcacatcgccgtctgatctaccagcctcgctcacatatgttgtgcctccagagtatacaaacacactgtcggtccttcaggaccgtgcgccgttcaaatccatgaaagaggtcgagcaggtctttctggaggagtttggtcagcatcctcatgatctgtttcaagaatttgaccctgttcctctggcagcagccagtttagcacaagtccatagaggtatgtcgtccagctctgcagttgttttttgcaagtcagtgtgccagtgcatgctaaccacatgccatttccgtcgcattgcgatagcgctgactttggacggtcggctagcggcagtcaaagtgcagtacaatgatgtgtcgcgtctcttcaaaagtaagacttgtcctttcgagttcatttagacgtcttcgcccatttcctgacgatggctaacctaacttgatcttgatttagctgacatgtggaccatgcaaacactatcgaacatggtcggatttttctttcctgaattcgagctcggttggatcgtggacgagtttcatgagaacttgacgtctgaattcgacttcacgaatgaagcgaggtatatacttgagactgtccattctcgtttccatactctttgcggcgtccctctgtggtgctgacccgttgtttgtgtcactgatgactctctaggaatggcgaggccacaaaggaaaggttcaaaaaccgctcggacttttatgtccctgagatctactgggatttgtcgtcgcgaaaaattctgaccatggaattcattgacggcgtcaaagtcaacaaccttgagggcttgcagaagctgggtgtttcaccaaagtgggttcgccagacgttgctcgaggtctttgcagagatgatgtaccagcatggagttgtccactgcgacccacacgtaagcaccgtctcccgcttcactttaagaaagtaccactgtgcgacacatcgctaaagcttgcgcttgtcatttttaggctggcaacattttgattacaaaggacgagttcacaggaaggagccggttcgtgctcttggatcatggactttaccgcaccttggacgagaccttccgcttcaactattgtcagctttggagagccttaattctcaacgaccaggagctgctgcaccgtagcgcggctaatattggcatccccgagaactacgtcggattcatccccttgatctttatccagcggcctgccaactccaaccagaagattggtgaaggcatgacggctcagcagaggcaagagattcgatcctctatgaagaacgtgaccatggctgaggtgtttgagtttttagagatcttgcccagggacatgctgttgatctttaggactattaatctcacccggggcatccaccagcagctcggcggcgacaatgtagagaggttccacatcaatgcgttgttttcgacaaagggcgtctggtctgagactcgcgacgaggagctcgagagaagagcaaggagagagaagcgaagacgggatagacttgccggtcgatggggcagactgatgtcgtggtggtatggtgttcaggacagcaaagatgaaaatagcacagaggctacgcggtctcacggaaagcagctaggactgggaccaagaaaccgctggtatctctttggggatacgcccacgctctaccgcagcttggggtacctctgggacagcttttcaatgcgctggagattatgggcagtcgagggcctccttcgtatttggctctggtgggcaggaaacgatgtagctaaagccataggctgagagtatcatgtccatattagacgcatctgaatagaccactgcatagacaccatactcatgtctctgtctctgcaaactgaaatgtcgttgctagatatggctggcatcacgcccgtggaacgtggcagtcaaggggaaggaccgggtcaaggcaggaagcacatgggatacagggagtgagacactgggattgagcgcgtgtggctcatgcgtgagctggaaaaggacgaaaatccgaaaaaaaaggaagggacgacttctcttttccaccaccgctccaattgccctcttcttcatacttgccaacagcatccaacctccatccccacccttcgcttgctgcctctataatgagcattatctatgccctggtcgctcgaggaagcgttattctcgccgaatacaccaactcatccggcaacttcaccacaggtagcgctcgctctgctgccgcaccatggacgaccgtggtccagtgcaggagttctaatcactttttttcccccgcttgttcccttgctcttggcaatattagtaacggaagccattctggcgaaaatcccacccaacaactcgaaactcacctatgcctacgacaggtacggccttttttttaatgctttcggcgcttctgttgacacgatgccgctctgccagaacttggacttttctgaaggactcaaatgaactcctctccatccctaccttctcagatacctcttccactacatttgcgaggatggggtaacctacatgtgcatggcagacgacacctttggacgtaggatccctttcgcatttctgctggatatcaagggccgcttcttggcgcattatggtcgtgaaagggcaatggtggcacttccgtatggaatgaacgagttctccaaaaccatcgcaaagcaaatggtaaggcgccccttccacttattcacgctgtgcagttactatcagactgagctgacactgcctctttgctgttcttttcttccccctttgaaggaatacttctcaaccaacccaaatgctgacaggattaagcaggttcagggagaaattgagcaagtcaaggatgtcatggtgcacaacatcggtaaggcgggtagcaacttgcaaagtatagggataggcaaatggaacggagaagacctttcatgcgtcgcgtgagcagccattcaaactcccgcgctgtcaggctcatatggttcactgatttttgaatgacattggactgatccccctatttaactgctgttctgtgtatcgacatcggaatatcgctatcatagagcgcgtgctcgagcgtggtgagcgtattgaactgctggttgacaagactgataatctcaaccagcaagcgttcgctttcaagaagaggagtactgccctcaaggtatgcaacaactcatgcgccacatatcccgcgcgttttaatcacggagataagatgccgttctggttcgctgacacccatggactgtaccatctctgccgtccttgatcctgactctactcctgcatttgtaatgacgcatcctagaggaccatgtggtggaagaacacaaaacttactatcattcttggcggagtcgttgttgtaagttctagcgtgatcgacatgaacctcttgaaagccttcacttcgcttacgtttgtttttttcgtttcttccactgtagttcctcatctatctgatcatctgcggagcctgtgggttccccttctggtcaaactgccgaacctgagatcctaaaggtcaagtctttgtcccttcttgatacccatccgctccttggtctcctctgccccccccccccctcttcttatccgcccccctacttatccgccctttctcgctggaatcgagtgaccaagaagaacaccgattccttaacctaataaatcgtcccttggactgctcaaggctcagtgaacggggcaagtgcaaaaaatgcaggcaccctctgtaacggccgactccccttaatttgcgttgtcggaagtgcttgagcatgctgaaaagatccaaatttcagaattcgcctcaacctcatccaacatagaccagttaccatgtcatccaacaacagcaacaacagcatccccagcgaggacattctcagccgcaaggtaacgcgacattctggacgttgcagggggactcttgcaggtttctttagacaaggaggcgttcctggtcagatcttggccgtctccttgttcacaagaagtgaatgcactatggatggtggacacacaaagccgctaatgcgaacccacgtccgatcacaattcgaatctttagtgggacgagtgcatttcaaacgtgattgtcaagtctggaatcggtctcagtgtcggtatcgttgcctcggcccttcttttcaagagtaagtccgggacatttatctttcttcagtctgaagaagtcgcgcgtcatacggaaggccgccttggagcacattggccgttattggaataggtcgttgttggcgcacttttcattttgtacttatgcgacgagctggtttgttaattttttgttcttaccttagagcgctcgtggcccatctcagtgtcgaccggtcttggattgggatacgctctctcacagtgcgagcgcaacttcaaccccactcttgtgcctgttgtgaagaaggctcaggagaagaagtagagccatggaaacgcggccagtgtcaagtggagcggcatcaaaatcaggaagatacgacattgcataacgttacccgaccaacacagttacgagaaagatcaataaacacaagttgctgtacacacatttctacactcatggctttcattccatggatcagtgtgagaatagaatagtaggtcaacgctgctttcgagtgcggagaagtctaatcttgtgatagcctttgactcgatcatcgaaccgagaaaaatgcacgtgatttaaacggcaaacgtgtctatcataggggcttggttttctgatcaagcttctcctccaactccttcacctttgccttcatcgcaacacacacgccgctcggatcgccccttcaggaacattatatagccagcaatgccaaagatcaggtcatcacgtacaaagagggcgcccgagggcttcgatgaaatcgagcccacgctcaaggaatttcagcagaaaatgaaggatggcaagtgactttctcacctttgggcgctatggccttgcgttgatcgcagttggaactcgaagccgtatttcgtctttgtccgatgtcagcaatgggggaccaactagcgcaggatgcggcccactcgacacttctggccgtgatagacgcctttgagctaacttggtttttttttgcaacctgcatcgtttcaaacattaatagccgagaacgacccccatgaaggcaagagaaaggttgaggcactctggccaattttcagacttcaccaccagcggtcgcgatacgtctatgaactcttttacaagcgcaatgcaatctcaagagagctgtatgagtatctattgaagcagggatatgccgacgggaatcttattgccaagtggaagaaggtaaacacacaaagcgtgtgggctgtgtggcgattcttcatacagcctctttgtcggatttccgccagcggtcaaccatgctcacctgttcgtgtctcttgttgcctcgattcgatagtctggatatgaaaaagtttgctgcttgaggtgcattcagccaaaggacaccaactttggcacgacgtgtgtgtgcagagttccccgggacatgctggaggaaggcaaggtagtcgagtgtatacactgcggatgccgaggatgctccagtggcagtggcgcggcatcaggcgccaaagcggtgacaggaagcaaagcaggagcatcgtcctcgaaggaataaaaagtgttcacagcacgtgactcgccctctagacctttggtgatgcacgcacgcatcctcgtttttttttccacgttttcattctttttcttttgacaatgtctccccaaaatgaacgtttatcacctcaagctggatctctactctgaaagcgcaacccacactgcaatctcgtcctcacctccaccgcagcaagcagacacctctcccgcagcgccgctcgcattgcgattccaaaccttgctcaagccattcccacagcctcaacaccaagctctagacattcgctcctcctctttgaaatctagtccgagctcaacagctaacaacgtcgagaccgacagcacacaaaagcagcgaaccatacagcaccagggtcacacaagtcaagcgcgcgaatacacggactaccggctaggccctattcatatatcgagtctggacgaaccaacatctttctcagcttcaacgtctcacacatccaaggacaaggcaggggcgcaaaagcacaagtcgaccaaggccaagaaaatggctgctaatactgttgcactgccaaatcgaagcactgggttccaagacgcagagccagctcatggaattctccgtctgtacaaggacaccaacgagatcacaacgggcgatctacacatccagtcagcggcagaggaagccaaggaaggcactatagccgcatctaccgaaaccaacggccatgctcctgaccgagatggatctcagactatccacccggaccaggatacggctgtctgtgttttggcagttccgtcctatatgtctcctggagactttttgaactttgtaggacctgtccgcgcgaacgtgtcccatttccgcatcatcaggtaggcaagatgattgaaccatccgacttcatggccgatcttgaatacctctcatatattgcaagcttagctaaacagccgtttttcttcttttctgactttttttagggatgcggtgcctaatcggtttatggtgctcatgaagttcaggactagcggagctacatcggaattttacgcgcgctacaatggcagagccttcagttcactcgaagtatgcatctattatcgttacactccagacagagtctaattttcaggacgtttgcaaagatctgaattcgcgcaacacggtactaaccatcccaaacatctgtgggctgcccgcattgaatagccagagatttgccatgtggtgtatctcaaaaccatcgagatccgagcgggatgtatgcctccgtacgcatttcccttcctgaacgaagacccttttttgcaaaacaaaagcccaacctctacgacagcctcggcatccacatcagcgatcttgggaacggcaacggcattggtggacaacgacttgacagcgacggatttgatctctacacaacacatacagtccatgacagcgtccacggatgccacaggactggcggaacttccgacgtgtcctgtgtgtctggagcgtatggattcctctgtcacggggctgctgacgatcctgtgtcagcacactttccactgtcactgtctcagcaaatggggcgagggcagttgtccggtctgtcgctacagtcaaaagagtatcaagaaaggctccaacaccaccgccactgctgctggagggggacttactgcgtcgacggatggcatgacggaggatcagaacgaatgcgcactctgcggcaccaccgaaaacctgtggatctgtctgatctgtggccacattggatgtggacggtaccaggagaagcacgcctatcatcactactatgagacctctcacctctacgccctcgagctcgaaacgcagcgggtgtgggactacgctggggatggatacgtgcaccgattgattcagaacaaggccgacggcaagttggtagagctgccgagtgcagtcgatggaaccgtcccgtcccaacacgccgtacaggtcggacaggaaaagctggacgccattggattggagtacacgtacttgctgacgtcgcagttggaatctcagcggctgtactttgatgcccagatggcggccatggcagctcaacttgcacaggtgaacaaggaagccaagcagtgggagaaggaagcgacagagttgaacgaaaggaaccgggaactggcgttgattgcagaatcgctcgaaaaggagcgggttccgatgctgatcaaggaaaagaagtcggcagagaagcggttggagaagctgcaggagaagctgcagctcctggagcggcagtatgaggaggaaaaagagatgaatgttggactgcggagcaaccaggacagcttcaaggagaagctacagctcaaggaggccgagatcatggatctgcaggagcaagtgcgggacatgatgatttacctcgacacacagcagagagtcgaggctagtccgatcaaggatgaacttgtcaatgggacagtgggggtgatgatggctccgggcggaagtgtacccgcggtttcttcgtcgtcgtcctcaagccattctcggcggaaaggtggacggaaataggacgccgataaaaacaagagaaacaacaaccgtcggcagtttcccaagaagtgagatatgttgttacaaagtcgggggtgtatggtttatttacaatgctttctgtgcagatgaagatgtgagttgatgggagggagggaaaatagcaacgtctaatggatcagactggcggatgatgtgcttcgggttcgctttcttcctcgaccttttcaagtctgtcctcgaccttttcaagtctgtcaccggtgccggcagcagggacgtttgcgggcgcggttggcctgagagtgcggtctgacaagggtgggtccacatccttggccttgcacaccacggcctcgtcagaagcaacgagcgtcgaggccgtgctgacatcgctaccgttactgcagctgcgctttcggttctggttcaggccatcgccttggaagatgcgggtgatctggcggaccgtgaacgagctgctgtagcgtggagggtcttgcgatggctgttgctgctgctgaatgcactctgcttttgcaggatgaccaccgggatcagcatcagttacctctcttgtcgcgacaacgttttgctgctgccccctcgttacgatcatagtaggcatctggcccctggtgcggtagcgattccggatcaggtgaacgtagtacatgaccacgaatgcaagagtgatcgcgatggcgacgccgatgtagagagccatccatagcagactgccagaggtgtcgaggaacgggtagatccagaacccgtcgacgtgatggaccagatgagcctcgcccaggtagagcaggcagacggtgaagacgatggtgagatgggtgggtataaagggcatggtgttgatcgcgatctcgaacatgacgacgatcaggtcaccgccgtggaaggagtaattgcgccagagcgactctgcagagatctcgacagccatgaccctcgcgtcgccttcgtaggagaggtatccccagtacataagcggaacaatgatactagaaaaattgcgagtgagcgcaaaatgaaaaaaagggggaaaaggttcgtcagggctttgcattcctgttgtccgttgagcggaatggattatccggatgtctgcgcacagtcatccttcacaaatttgttgagagcaaagaatttgcttctgcaaatcaacccaggacaaggggatcgcctccacccctgtcaccctggatgtgccacaaacaaaaacaacacgaaacccaaccggtcggacaagtgaataaaaaaacttactggaaagtgcagatggtatggtataggaaaaagttcatatctgtgaggagccaatgctgtcgttcgatcgtggtggtcctcgtcatcgccaccgtcgtcatcccccctgcgcccgttgcttcttccatctgcgcagggctcttgccaatcaatttggaggatgcggctcggacggctcgttcacgccgccattcactaagcgtgtgccatgaaaccgtctaaatcaatcgaaaaagagaaagacgccatttgattatttttttttgttagagaattgcggcggattttgtcagcgttcctcctcccccatcggcgtttttccgcgtggtgaagcagcaaacaggttgagaatgaattataattgtgcccgtccatccagccatcgtgcgcagttttgattacgagcggaaagggggggggggggggaattgaatatatggacaacagaagcaaaggtaagagattggatcagaactggttccaattgagttcgaattcgcttgctaagcgggcttttttttttctgcggctgctgcgtaacttgaagcatgggttagcattgccagagcaggagattggaaggggtggaggggaaaagcccttggagaacaaaaaggacaccaataaccttcattctcaagaagaaaaaaaaaataacggctgcgacgatgagatttgttaaaaaacgaaatagcacggaaaactagccccgcgtctgcaggtagtatgcccgggccctctgtttcagcgctatctcgtacaatgtgtggtactctttttttttttgacccattcattctcggcctaaaaattgacactcactcatggacattcgtgtgggcaaccctctgctaaaatagcacacggggaggggaggcgggatgtggaaggatacacagctcgcctttcaaaaaggataaaaaaaaaacatatcaacttaccccgagataggacgtcaatcccaagtacgataactgggtcaaataacaaaatgcatagcgcggtcgctccgtcataatgagatccgccaccagaacggtaaacgtgtacaagaacaatgcgaaacgaatgaggaacaaccaaccggtcgaagcccagctggatcgaacaaccgcacccgagttcatctcggacctttcaagtccaaagaaccgcgtgtacagcgaaccctggacccttgagggatgccgtggatgctgttgtgatgcaatgaccacgggacgtgaatgctcctggccgtgcgtatagtgatcgtggttgtaattgtgatcactgtggtgttgaaggggcaacggtacaagacccacagtttcagtcaggtacttggagtcttgtgtagatttggagcactgaagggcgggatcggctgcgttgatcagggccatgcccgtgctcgcggcatcggggctcttaatcgaatcaagagcgtggttgctgcgagcagttgttgcggtggagagtgagtcgtcatggaggggtgaagggagagcgatggtgcgaatggcttggagttgttgttgctgctgctggaggtgttcctgcgtcaaggtcagtgctggcggtggagcgataggagcgatggtgatgatgaggtcgttggaaaatgaggatgagtgctgttcagcgaaagatcccctgccatcgacagacattatactttttctcgatgtacagggaaaggagaccagggggggaggagaaggggggactgagaggggagaagagatcgacgatgtaaagatgcggtcgttgttgtggttgcttgcagattttttaaagggttgttgtttttcgatcagcacagctcgctgcacgcaagggtcaacggcagccacgcgctaaggatatcttgcgcagaggtggagtccaaaaccagatgagtaatggagggagagggggggaacaagacgatagagaaaaaaagggggtttcatgagcgaggtcgagcgtggttgcgtgtgcggcagaacatttattgcgctctcctccagttttaaaatagcactgcgactgaatcctcatttacttttgcacaagcgccacaatcaggcatgtcttttttccgttcaaggcgtggccatgtcgacaaagatcagtttttggacgggaagggctgcggggtaggaaaagaagcagatgaatggggctgaggggggtaatgatgcatatctaaggcctctggatgggataacgttccgctgctgaaaaaaaaaaagtgtgataaaaacttgagatgtgcgagcttccctggttcaactggttttgacgctttgaaggcgagtggcagaacgatttttcctgtgcgtcgtggcatcagcggcgacatccggcgtccttccttcctcccttcgtgaccagaactaaggtcgctccaaatgttttatggtctggagttacagcgcccgcattgcgcctcattgctgtagatgcaaagcaaaggactcaacggcacgactgaaggggctaaaagaacattcacattgtatataccgtggtccttcccgtggccgtcggccgttgcgcagatcatggtccggccaatccagtaatatcaatccgcttgccacagatcttcttcgacatcattcgatggcttctctaagcatagaaggggtggggggatgtttgacaatgctaccgtaattatcaacaaaagccgcgtgggctgttggtcaccaataattgacaggtcggcacttatgccgagtggtatgggctgcagctgtagagaacgtagaacatgcaaatgcgtatcattgggagcacaacagtcagacacgcctgtagaaaatatcgacttttgcgaagggtcagggtacctgtatttatgcgattcactctgaccactcagcgctgctgcttggggccgcatgagacagtgtgccatccggaatgaccgcgatcaattagcaagggcggcatagcgggtggtcgtcaaacgctttgctcaacactccttgggcagcctttagtgcgcggatgccactgcggggtggcaggtggagtgcatgatttgggcgttcgtcctagaggatatgcatgggcactccaaacaggtcgcggaacgtgctgattgctgtccacgagacagtaacgcgtgtgtgctctgtctgttactacaccgtgccgtgttttgcagcaaagatctaggagcgagcacgcgtctcgtctctccctctctctctcccctctgattctttcttgcaccgcattattgctctcgcagcgaccccaagcacagagcacgaacctccctgcagccttgccagtgatctcatcgacaatgagcaataacgtgacaccgcgatgggttgcctaagcgacatcgaacgttcctctcacactccagacaaaaaaaaagcacactcacacctcacccctccgagcagttccaacccaacgtctgattcaccacagcccatcgacctcgcctccaggcagcctcctgtcccacgtccgtctccacactccacacgctcttcgttcgcctcactctttgccctcaccctcgcactcgctctcgcaccacagtcagccaggtcgcccgtccactctgttcctgagcccagaactccacatgaccgcgatgaaccaccacacccctgtggtgctcattggcacattcaacatgagccagagacccatcgagcaggacctcgcagactggctcgccacccacccatccctctcctcgcatgtcgcagactcggcgccgagcagccccgtcgaggcaccgactccggcctcaggaagctcagcccccatcatgcccgacattgtggccgtggcccttcaagagttttccccttacccggacgccttccttcacggcacgtatcatatcaagcagaagattgatgacctcgccaagctcatccttcggaccctccaccgcacctgtccgggctatcggttcagcctggtctcacagtctgcccaggtggggatgatcctctttattctgacccgagacggctccatgaccgagcgtatcgacaggatctcgaatgcctccgtaggtactggaccgggtgggatgggtaacaagggagcgatcgcgacgcgactctcggttcggctagcaccgaccaccaccagtcgaccctgtttcgagatttgctttatcaacgcccatttgagtgcccacctcaacaacatcaaacgcaggaacgatgactatttggccatttgtcgcaggatggtgttcctgaacgacggcgacaaccatgtggagggcttgctatgggagcatcaggaccgactctcctctgctggttcgtcctcggcctcgtcctttggtacgactgaagacggcgacaacgacgatcgtgacgacgatgacgatctataccatctcgacaatgattcgaggccactactgcagaagaaaaagtcggcttctactcaaaggagcaacagcaagggctctagacggtctagacactcaccgctacgcgctcaggatgagcaggacaagaaagtggtttgggaagagaccattttctcgtgcgactacattttttggacgggcgacctgaactatcggttggacctagcacagtcggacggatcactgagcaagaagaagaaaaaagcaaagctgtcctcggaggatttgctgtcccagaccaccatgccagacctcactgcgggtgagattgtgcacgcgatccaaacaggacaattgcggtctctttatagccatgaccagctctcggctcagcgcaagactttgaacgtgttccgaggctttcacgaggcaccactcgccttcccacccacctacaaattccgaatggggtcgagccagtacgacattgccaagcgtgtgccggcttggacagaccgagtcctgtggtttgtgcatccaagagatgccacgagtttggacgaggaaagggaggatgagtttgacgcgtgggatgaacattcccaaggtctggggcatggacagctgcccctggaaccatccgccagcaaggtcagtcacacaagcaccagcagcatcagcagcagcactggcggcaacagcaatggtcgcgggatcggcagccagtacagcacgttgaagggagctcagtcctcctcaggggcgtggacaggatcgaaatcccgtggcacgttctcgagcctgacgaagaagggttcggccagagccgtgattaacccaggtctgtttcaaccgcctgcgcccctcactgctgaaccagaatcgatccgtgctcagcagccattgtcgacagcacgctcctcaccctcggcgtcgagtctctcagccaggaacagttttgcacaggcctctggtcaggcgccacagctgccgtttttgacacagagtccggcatcgagtctgatgtcgaccacgtcgtctcttgcagagcccacgagcaaaagcccgctgctgattcattactatacctcgcatccgctttacaagtcgtcggaccacaagcccgtttcggcgctgttcacgttgctccctcataatctggcagcacagctgacgccgaacccgtatggcattgatccttcgtggaagatgaagaagtggattggcaagaagctgacgacggtggtgggccatttgctgcgatggggtttccatgtccttgggctgggtgtctttgtcacgctgatggtccttgtgcgacgccatcttcaacagggctggtagtctgaataggaacaggcaaatgcgattgatatgtagttatatctcacttaatataatccgactcttcagcagcctagtagtcctgtggtggagggggtgggggcgagcaaggttgtggggatggcagtagactgtcttcatgctggtgcaaaggtttgacagttggtggtttgtgtgccaggggtaatatccatactggtgcgtgctgtatcgcaaaacaaaaaaaaggccgatctgcgatgactcaaactgagtggccccacagactggctgtcttttgagtgaaatgggacttgagtgacgatcgacggactgtgaaaatggcgataaagactagatctcgctccattctcaacaaaacacacacactttctctttttttttattcattccttcttgttcactcttcatttgctcacctgcatcgacacttcgcaccctgtcctatccaccgcttcctcccttgcattctttcatccaccaccagcacggcatattcgagcacacatacgacacaagacacacacacaacagccacatcaacaccatgacaggaacatatctgctcgactatggcgcaggaaacgtgcgcagcttggtcaacgccgtcaagaaactgggccacgacatcacctttgtcaaggatccctcagacatcctcaaagccgacgtacgttcatttttctgtcataacggctgtatctgcgacgtttttgtacaatgagaaaggaaccctggccgtaccgtcggagaattttttttttggtctatcccattgtgggagaactcgaagagagttgtgtgctatccacttaaaacccgaagaacctttcctctttttttttttgaccaaactgttcctctactatttttttttttattccttgcagaaactcatctttcccggcgtcggcgcttttggcagtgccatgacctcattgcacacaaagcaatacgccgaacccttgaagcaatatctcgccctcaacaaacccttcatgggcatctgtgtcgggatgcaaaccctcttcgaagggtcggacgaaacccccgagatccccggtctgggcgtcatcccaggaaaagtccgtctctttgactcgaccacgaaggcggtcccgcacatgggttggaacaccacccgttcgatccaaggctctcaacgcgctcaggactgtggactcgaactcggacgcgcctattatttcgttcattcgttcgccgtgccctttatcgagggctcccccgaggccaaggaatgggtcctgaccacgacccagtacggcgatcaaaccttcatctcctccgttcggagaggacacatcttttgcacacagttccaccctgaaaaatctggattcgcaggcgtgaatgtgctcaaggccttcttggaaggtggggccgccgccggagccgaagccgatgcggccatgctcgcccagttccaacaacaacagcaatcgttgagccccggagcattgtcgtatttggcacccagcaacacgatcgtcccaccctccaaggacgaattcacgaagcggatcgtggcctgtttagacgttcgcgccaacgaccaaggcgatctggtcgtgaccaagggcgaccaatacgatgtgcgtgaacaatccgagagtggtgaacagggcgatgtccgtaacctgggcaaacccgtggagttggccagacggtactttgaggagggcgcggacgagatcacgttcttgaacatcacctcgttccgaaactgtcctctcctggacatgcccatgctcgaggtcctccgtcgcacgtccgagaccgtctttgtgccgctcacgatcggaggcggcatcaaggacgtggtcgatcccgatggtctgttccatccagccctcgaggtcgcaggcgagtatttccggaacggtgccgacaaggtctcgattggctcggatgcagtctacgcggccgaaaagttttatagcctcggtgggaagggcgatggcaccagtgcgatcgagaccatcgcgcacgcgtatgggtctcaagccgtcgtgatctcggtcgatcccaagaaggtgtatgtgcactcccccgccgatgcgcccacccaccatgtgatccaacccgctcaactcggtcccaacggcgaacgctactgctggtaccaatgcaccgtcagtggtggtcgtgagggacgtgatctagatgtccgtcaattggttcaggcgtgtcaagccctgggcgccggtgagatcttgctcaactcgatggatcaggatgggatgaagcaaggttacgatctggccttgatccaggacgtccgagacgcggtccggattccggtcattgcctcctcgggtgctggatccccccaacactttgtggacgtgtttgaaaagaccggagtcgaggctgctttggccgcaggcatctttcacaggagagaggtgcccctcgaggacgtcaaggaaaccctcaagaacaagggaatccgtatccgcaacattgatgcgccactggctgtctaagtagaatacaagaaaaataaaaaaagtaaaaagtgcgtgcaaagcaaaaaaaaaaaaaagtagagactgcatctgtttcgtttatggcgcataatttacaaaagagaaatctatgggagggagaaggtaaaaaactatgaaaaacaaagacaccaaagagaaaggaaacagctagagtgagatgcgacggggtgagaaggagagagcaagtgaggacactagcttagcaaacggaacccaggcaggatcccaaagtcggatcaaatactgaaaagcgaaaaaaaaactatagggcacggtcatcaaggcgagtgttaaaagtaaaacttgagcgggcggatcataacataaaacaaggcgggaaaaaaggcctattatcctttagccggggtcttctcatgacggccctggcatttcagatgacgaatggccatcccgaaagaacttgagggggctgcgcgaggctggatatgggaaaaatataaagtcatgatgtttttttgggggagggggggcatcgacgttaatagatgctatcaagcgtcgttttttctttcctgataggctgaccaggatgggtgggtgtgtgttgtgcaaggtgaaagttttgcatggaagggcgtgctggtatgtctttttctgcttttctgcttctttttttttttttttgttgttgttgatcctgaaaaaattgtgggtgcttgtttgcttgggtagatcctgtgtagattctgtggttgtccagaaatggttgctaatgtcctgtcctcactttcaggctttccagtcactgtctctgtctctcctttttgcgttgcctttctgatgaaatgggggggggggggggtcccttggagcatgaactattccgagtgtggatgactcttctgatccagaactgggagcacatcattgttgaccttgagcgcgtggatcataaaactcaaaaatcgctgggcgtactccttcgggttcacggcagagatcgcatgctatttcagagaggcaaataaaatgcaagaaaagcgtcagcagagaaaaaaaagggggaagagaatctgacgctggaagaaacaatacacaaatcaagacctcagttgtctttttcttaccttgtcttgactcatgctcttccagtagtgctcaatcttcttgacgtagttgtagggcgtcagaatgtcaatgataccaaggtagtagaggtcttccccgcgttcgttctgctcgttggtcgataacagtcctccatcgtccgcgtaaaatatgcagtgtcttcgttctgaaaatgaatcggacggtagagtggacggtcctaatgcgaccggatccgagaccttgaccgccatcctgagagcattcaccttgctttcccgtttgtcccgtcttgaaggttctctgacaagctgcttcgttgtatcaggctgttgtgtggcgggtttcgatgagacacacgtcgacaacagtaagtaacagaataacctcaaaagtcaaaacatgaagtgcaagaaatgaaacaaaaaaaaacttacatggaacaccttgagtgtgttgtcacgaatgttgtccttgttgccgcgctcaatgtcatggataccgatcagcaagctatagtccatgatattgagccgggccagtagctccacatcacgcttggtttgctctacaaacagatgccgtttttcgggaccgagctccagtttgcgattgcggttcacccagttgaggtccttttgtgttgcgcgcgggttgttgttgagctcttcatcactaatggcacggcctagcgtcgaacccttcaaatcatatgtctcgtggatatcccggttgggcgggaatacattgcccatgaccacaaagtggatcttcttcccgtgagggagcttgacacgatgcagcccaaagaatcggcacaggagagtatgtgggttttgcttgacatgctgatcaatcaaattcgaaagagacgcaagggtaattggagagtgagcaaagaaggcgcaaaaagttttctagtttagagatatacacgttctgcaaaatgcgcactcacgttgaaatagtccttgaggatctttcgcataaacttgtgctctgcatggtggatagttttgataatgaatcggtagtcctgagaaaagtagaaaaagcttccacttttgccaggcgaccccagctcagagagaatgtacttgctcgttaaggagacctatgatggatgcatccacaagacagagtgtcaataaccgaacaccaccagcaagaagcaacgtatgtcattcagggaccccactggcttaatcatcttccccctgtctttgtatccccttattttcttccgcgacaaaacgaggatatgggagcacccgaaaatgcaacccgagagcaccgcatgcacctctgcagaaatgaaatctaatatactgagggcaataaaggcaaaaaatagatgcgccccgcacacaacacacacatccacacagcccactccatagccccatagatatctccttgaacacaaaagacccatatggctttcgtttcctgcggagtggcgagggtacaaagataaaatatctctctcgctctactctgtctctgtctgtgtctctccctctgaggcgctcgaaggcctgtggtttttcaggaacgaaaaaaaaaaaaaaaatgcagccagcggcaaatctctgcaatccatatctcctgccgccgggctcacggaccaaagtaaaacatccccctcatcatcggcacgccttgaattttcatgtattcatgtctatcccagcagaaccttgccacgcatgctccccaaaaaaaggcgcgatagggggggggaaggtacctgtgacttaccagatagtctgaggcgtcaatgtgaaagtcctctctcaagtggcgaaagacccatggcgcatagtccttgaacttgaagtcgtactttgacgacggcgttagctcattacccgttctaagaacaaccaacagagacatccatgaatgttagttgagcgcgggaaaactgtaaatcaagagcctcatcgccaccatgaaaatctacttacatatcaaatgccaacttgtgtgcagacgtaaagtcctcgtccacaagtgccctttggggcttggcttggcagcgagagaccttatgacaagacaaagacatgggcatcgaggaaggaccattagtatatcgcggtcatcctccagaccccccttagtcgccatctgaccgatatcgaggtcatctctctacgataaccccccctcccaaacaatagcagcagcactacaacaatggaataacagcaagagcaacaaaaaaaaaatgattgatccgttacggtccataaagtttcacttacactgacgcggataccggtcaacatgttgtacatcagtacgtagttgacgtggtcctctccgatacgggtgccgatcataacccggtcagtgtcatcatccttcttgcgcttggacatgcgtcgactactgctcttcttaagagcgtccatcctccggcgtgcctcgtcaagctcatccatctccatctcgtcgtcagacctgtgaaacgatgtcgaggccaactctgcagagtacgtgttgcggcggtacattttgttgcgacgcgatcggctggagctctctgcttgcggatcaagttggctttgctgctgctgctgctgctgctgctgcttggacgcagacgacgacgctggagagtctccgagcaggatcgaccccgaatggattcgacgatagtccagagtcgaggcacgcgttggtgggttgaaggctgcaggcgaatgggcctttgacggcgagatttggtacgcaccaccagcacccataacgcccatgggggtctctgcagggagagtggacatgttgggccgcgcaggagaagatggctccggcagggccgaggcgatgggctgttgatgatctctgttctcttggctgtggctgtttgactgatccaccactgacaaaggtcctgcgcccactggggcagggggtattggtagagttgcgagcgtggtcatgttggccagagtggacgacacatctgtgaccttggtgggcgcatagctcgagggccgtggacggttggtcggggtgctggcagacgaagaggtggtcgaggtcgagggtctgggcgagcttgcggaaagtgctgccaaggccagatcgacaggcgagggctggactgtggcgccgacaggcacggagatggaggacgcaggcgacgagttggccgttgactttgaggccaggctggcgggaaaggattctgtggtgctcagcgtgggagagggttccagtgcaaaataaggctttgattccacccggtgttgttgctcctgaaggtcgtgtgcatcgatatcattgctatggccattgttgctgttgctattgatattgaagctaccattgctcagactgtggccaagaccacggccaggtgcccctcctgtgaaacgctgctgctgctgctgctgttgctgctgctgtggcggtgggaatcgaggagagaatctgggcacaaaggacgggtcgatcgaggctggctgaggaggcgaaggtggcggtgaatggggctcgtggtgctgcgacttcatctgagatgcatggctcttgggcgtcagcgatgatatcctcggcggggtcatgggaatctggatggctgcagacgaggatgaagaggcagacacagctgctgctgcaccagcagaggccagtgctggattggaatgttggttgctgggcgagtgcatcattctcctggcatgttcctgagagtgctttggttccggagacgactgaaaccgagcgacggtgcctgagggccaggtcggcagtgctgcgaacgaggacgagtgcgaggatgccgacggcgtgggcgagtgtgagtgtgagtgtgaatgcgagtgagagtgcgagtgagagtgctgctgtacagaggcggagagcgcgggcgagccgtgagggcctgggtcgatggtctgggtgccctccgagaccttgtgcaggccagccttgagctgctgctgggtcatgacgggcgtagcatagacgagaccgtcgctctgactgtcctcctggaggaggtcgttgtagaagccattggcgtggttgcgctgtgggtagtcgtaggggtcgtccgtggccagactgtctgtggcggaggtggtgttgttgttgtcgctgcttctgctattgctgctgctactgctgctactgcttctgtggaggtgctgagggtggtgcagcgggtagtggtggctgtaggcattgccactggcactggccgtgtccatgatgtcgcctcttgtgtgctgccgcaacaattagcaaatgtgcgagagaatagctcgagtctgtgagtgggagagaacgagagcgagagagagcgagagagggagagagcgcgttgtgggagtgcgtgagggcgtgtatgagcgaggatgaggacaggaggtgtctgtctgtctgtctgtcctgtgtgtgttgttatctgcagtttgtgtgttgtggagtgctactctcgctgtgtgagtgagtgagaaagtgagagagagagagagacagacaaagtgtgtgtgtgtgaggatgaagagacgacgaaagggtatgcgggtcttgcaaggaagcggaatggggcgttgggggctggtcaagaagtcggcaggggtgagggaaacaagaccatgagcacgaggcgaaagaaacaaaaaagagggaaacaaagcaagaggaggatgaagagataaaaaaaaaagtatatgggaatgtcgaatgagagagtgaagagagaagaagggaaagcagaagagcagagaagagagtgagcgagtgagagagtgatcagttcatatgcaacacaattagtcgcttgacagcaagatgggctattttggctgcacaagaacgcaaattcaaagggcgaaagacacttctgctatgtatatttttttggattgattacatgtaacaggcatgacaagcagccctcactcgacctgaacagccatggagtcatggctgcgtgtacagtactgtactgtactgtcttatactgtaggtagagcgcatgtactctgcactcgtatccacaattcacggactcgctcgtggcgtcaagagagctttttcatccccttcgcagccttcctagcggctcaccgtgcttctttgtgttacttgtcttgcctctcttgctccctcactctcgctctcactttctcactcactctctctcactgtctcttactctctctcagttctcgttcctcttctctcacacttctcgctgtccctcgtcctctccttcctctcgtctcgctactctccattctctctaacctaatctctctagtctgtcctcactgtgtcgtagaggatcaacaaataaaaaaaaaacctggttgcgatcatttcagttgcacactctcaatgtgtcgccctggcatggaccgtatcagctaagtacttgcatccattcacccgtcgtctacatacctcattctgcctcttcctctctccctcttcttctctctcttcctctctcttcctcaggcaggcaggaaaaacggtttatttattgtgtatctttttttttcttttcttttcttttcaacgacgatagtcctcattctcaaatcgcgtttcccagctgtcaaaaggtacatctcctgacgaggctgtggcatcaaagagtcaactagacgttgaatcttggatggagaatgatacttctggtattcctaggtctactctgggcgaaaaacatgtatgtcccttccatttcatccattggcatccaaatcttcttgatccgaatttttgtttgttgttgtattttgttgttatggtcgaaatcggttctttttttttttttctttggtggttgatattgagtaggaggctggccgtcaacagcacaaaagaaggggtttccgtattcctgtatggggaggtttgttctgcgaaacaaaagagaggtcgacaatggtgcgcacatccagtccagagacatccgacgtgtccatgtctgctccaggcactccaaggcctagacaaagtacatcaagttcttgaggtccgactatgggcatgatagtattcacaaatagtaaaaataaatgaaattgtacgattgtaagcaacactgtcgcagcatatgaacatggactgatcagaggatcaaagaacaaggtgcgactttccaatgaaacaaaaaaaaaggacagagcgaacttacgcttgtctggaatgtcggagcattcgacgcactaccgctgctagcactgctggcagtgtccgaaaagtcgttgccctgatagtgtcgggcacggtacgcgagcagatgcgcatagtacaccgatgggacaatactcacggccttggggcaccgcgcatacacgtggcatagcctgtacgtcagcgactgaagtccatccgcagtgaacctgttctcgtccatcaacacgtggtacagtgtcgggcgggacgttccttgaagccctccgtgactttgtagatctgtatgtcacaaggaaaagaaaccgcaggcccctgttagaatggcacttgttcaaagcaaagaataaaaaaagaaagaacctcaacgcattcacatcaatagcgacgaatagcacttacaaaagtcaaactcggtagggtgcgtgatgacagaatccaccacagtaccagcgacacagtttccagacttgtcggcctcattgttcgacatgggaaagaacctggcatggtgtctcttcttgaccacacagaacgtcaccgggggattgtacttgactatttatacacaaataagagagggagaggggatcttagtctcaaggtctttcaacgcgttccttgttacgtccacttactcatgagaccggaagacacttaccatccacacgctggcacgcctctttcaccgccgcaacctcagtggccatgacctgcgcatactggccctcggagacaccgtctcggtaaaacaggatccgatctggaaatcgaccgttcttattcctgaaggtaaccaacagatcatacacaaggaatttgagcccgtcgatgacctatcatgaaccatcaagcagaaaggttagccgcggactacatacaacacgcacgtatatacacatggtccgtatccttgacatcagtcagccatatcaggagaaacagtaaagagcacttggatcaagcaaaagaaccgctacctcaacaccgctgtcttgaaccttaatacggccagaatacttgaacgcttgcgcgtccatcgacccaaccacggcgaccacggagggtcgattctcgcccggagcagggtgcgtcacatcagctccaagaatcatggtcggcttgtcggtgaggaaggggatcgatgccttcacaagcgtactgttaacacccccgagctaatcgtaaagtcagaaacaatatatgagtatctatatcggctcttcatcctcgtatccctcaagggctgctcgcttcagcccccttctcagcaaacaaatcgatgcccataccttggagttgattttcagtccgagcattccacagtactgcttgttcacatttcgcagcttcttggacaagacgcactgggtcatgacgccagtcttgtgtgcagtctcgcagtacgttttaatggcggaatacgtctggcagacggacggaaggatcaccaaaataactagaaaaaaagcaacagagtcaacgaaatgtccgcacttggatcaaaaacggttttggtatgcgccaagcactacttacgttgaggtggcttgttgcaactcttcaagatcgtggcacacatggtttcaacgcttttctccacagctcccatctgcgcgtacaaaatgggcggctctttcttgggcacattcatgcctatacatgcatgcacagcgagtgtgtttagaaatgactgaacaaaggcctgcaatccagctgaaaggaaaatataaataataatagtgggcttaccgttttcggagagagtctgagtcaacatgcgtacaaagtcagcgacaacggatctttggaagcgcctacagtatttgcaaaaggttaaacaagtcatggtcaaacacgtctcaaaccatcaactatcatactctagtgcatctacatttcggatctgcaagaaaaatcacttactgctcattttcaaacactagtatgccccatgacgccaacgttgcaccctgcaccatcttgcgggtcggattcatctacgaaacagtgagcaataggttagtcgaacagtcctagcaacattctagcacacgtgacgtcaggggggtttttggatgctggcgcatcggcataccgtccacccgccaaactgaggctctgcggtcactgctccattatactggatcctcggagcggtcaggacacgcgccggcaccacggtcatatccttggaaacttccatcttgaagcccttcatatattcgttgttttcaaagtccaggactggaaagtttgcctggatctttgcagcgcgttggaaaggcttgaggcaagtgcctttgatcatctcggccgtctggttctcgtcgagctatcaagttcacagctttaggtgtcaaatctcaaggctggcatgatgtgtgcctatcacagcactcgcctgcaatgtgtagcatgctgcctcacctttttcatgtaccgcttgcccgggacgatgctgcacacctcaactggaaagtacatggtctttccgtctcgagctttgacgccaatgcatggcaaggacgggtagcggagcttgagcgaatacgcagccgagaagtattgcgggatagacaccttcgctgtcgttccatcgttcatttcttgatcaaatgtgatcttgtccgctgatttgaggctcagctcagagaccttgaaccgcttcttgaagtcgcctcctcggtgggtgacggtgaaggcacagcccttgaagtgacgctgaagacgctggatatcgcgtggttgcagtccgttgcgcaggtcgtcagggctacggacattcatgatctcggcaatcaagcccgcaaggttgccacctttgacaaaggcggtcgaggcaatgtcgatgttggcatacaacgtcccttggccaggccggacagactggaaaattccgtcccacttctcgattccgcccccgagattctgagcgttatctggtctaaaggcagagcggccgacactgaccatgttggtgaacaacttgtgcgacatcacaatgttcaacgctagtgaggcgaacaaaaaagcggaggtgtcaggtatccacatcatgaaaaagagaggaacggccttaaagctaaaccacatatcataagatgtaaacgtaccttgaatggcggtcaagcagcttggtgtaagaggccctttgcggccaatgaaacggtgaagctcctcgagttcgatcctggcgacacgggcaattttgacagtgaactcattcttgcttttggcagcggaggacggagcaggctgctcggcggtatctttacccttgcccttgcccttgcccttacccttgccaccgccgccgccgccagggcctttagctggggcctttgagggtcctccagtggctgacgagccagcgtccgggagctcaaacttacgggtgagcttgtcaaccgtcatctcctcggcggcgtacgcgttgcacttgccatcaaagaccgtcttgtgcttagcaatctcggggaaggtctcgataactttccatacctgttgtggccgcaaagacaaacgacgaaggtccaaaaaaaaggttggagcgcgttgtcagtgccagtcaataaaggagcacgttagggaaaatgtttgcagacaagggggcaaagtcgaaggctctcgggtgaaggcaatatagccttatcatgaaggaaatattctacctggcgagccttgtcggcaggaatgtccggcgtgatggacacgtcatagtgccaaatggtgtcgacttgcagctaacaattgtgaatggtccagggaatatacgagcatgagacgtttataaagttagagtttctgggcgccatgtccaacccctcaggtggacgtgcatgcatgggcttaccttcttgatggcaaagaagttgcttcggatgttgacgggcctgccttccttgccttggccaggtcggcgcgcgttttcggtgagggacacaggcccttgggcggtcgggtctctgagcatggtcggtcagcgtacgtggctcgagggtgtgaataagtgaatggaatgggtggatgtgtgggagtgtgacggcgcagtgaatgagggtacgggtggaaggggaaagggagagagggaaagagagaaagagagaaagagagaaagaaagctaaaaaacgagcagggcatgaaacaaaagaaaaaaccaaagccatgctgctatatcaatgcatcactgctggcttggccttttatttttttccacaccacaagagcctcacaaacccaccttcctcatgatccgcgcaaactcttgctcactcacgcctccatcgccatccttatcggcctcctcaatcatctcgcggagctcgctgtctgtcatgctcaggcccagctccgtggccacacgccgcagatcctcgagtcgaatcactcccttgtcttggccatcaaagagctgaaagatccgtgatacctcgtcctgtccatgctgcgactacagtggttgggtgcgcaagttgcatgtcagtcgatatctctcatcagcgagaatgctgcatgcgactcaaagaccctttactcacctcgttgggtgtcatgattgtcaaaaaatcctgccatgtaaaatagagcacctcctcctcctcctcaccgtcatcgtcatcgtccttctcatccccatctccttcactttgtccatatgcatcctcattatcatcatcctctgaatcgcctgcctcgtcatcctccgaatcgatgtatttcggcagacccttccttgatgtagctgctgctgatcgagagctcctcctcctggcaccgacctcagctgctactgcctttcctttgcccttgtctgtacccgccttggatgtcttgccacgtgtgcgccttgccatcccttttttcttcttatgtacactcaaagagggcatttcattcacaatctcatccatatccttctgcgatgcttcaaatcctaaagtgcgcatcgcgagcctgagattgtgggaagagagcttgcccgtgctgtccggatcgtatagctgaaaggtatcaagaagctcctggcgataggcagccgatactcccgtcctcttcgtttcctgatcgctgtgggccataatatctcttggctgctgctgtcgataaatagtgcgttggcctattctggtaacgtagataacgaggggcgacgggaggaggtggatcaactcagttgaccagttgtcgagccttttttgagcgagcaggatgctgcagctaagccacctacctatttttgcatgtgggcttgtgaagttgtgagagggtgcgcagatagaggcgttgcttcagccaaaggcctgtgtgccctgttgaactggccactatgtagagagtctacagccctacaagccatagtcgcccactgcgtacatgaaaaacacatctgcaatacacactgtttctccgtttccacgacgctattcaatagcgcttctcctgctgttcaggccctcgctctctgtttctttctagccctcatcgttgctgagtgacatccctgcaaagatcgcctcagttcatgccatctcaacaatgagcaagcgcatcgaaaaacgcatccgctccctctcctgagaagccccgggttacttagtggaagtgtgagcgtttttctcgcagcaccgtcgtctcatgggtccattgctaattttcatttcacattaccctctaaatctagcttttttcctagcaaacaacggaagcgcatctccaggtctagttcgcagacactacttttcccggaaaaagatcagagtgagaaaacgagaaggctgtgtttgcctgccatgttggttgaggccatagagtctatagattcctctctgcgcgtaataaaaagtttgctgtctcagtcgctgactatcacaaatccatcagtgaaatcacagcgctgtcaatatgaagcaatgggccgttaggcggtgaccgactgctgctataaatgtcgtctttgaccaaggatgcgtctcttcttcacttttgccttctttcgaagtggatcagtctcaggtaagagcttaggcagtcaaagacgcaaagcaccttgccctgtttcccactctcctgcactccactgagtcccttgcttccgcgttctgatcacattttttcttcttcttacaacgctgcaagaaatgagctgtcctatgttccggtaagtgaactgcactagtgccctcattagagcatgccccagaactcagagcaggcgtctaatcatagcttcttgtcgttgcaagtcgtgcaaggtctggagtttggtctttctccacaccaaaaaagaccaccccaatgtgccccctctcctttgcttctttttttttcttttgcttgcttgagcattgtaagtcatccacgtcttttggtcctcatgtcgagctgcctacttttgaatgctttctaatattcctcgttgctcacttctctttgaaacatcagtttgcttccagggacaagtgcattgggtcgcgaatacagccagatattcacaactggaaaaagaccacgcttcccccgtccacgtggactccgggcgagctcccctactgagggtgcatatagtaagttctgtaaaaaaaaatgtttttttgaacagggatacacgaacacattctaacatttcaagttttcaactatccctggtaggcctataaataaaactacacattgcgtcgcgttgcatccgagctggaagaaacgcacatctgttttgggagtagctcacttgggcttgtctgcccctgcttccctctttgtaatgccaaagggggtgaataacaagcaacaaattcggcgctaaacaggggtgggcttcaggttccctgtcagagctaacacatgggggttgtttggggggagacgagccgataagggatgcacagtgcaaatcttgtttctatgtcttcattacacacacgggttctctagatcaagtatatgggtatatggtgaattgcatgtgcagtctcacgcaaggattttcacattcccgggccgtgtccactctgcggtgctgcaacctgcgatgtgcatctccgacaaacatgagccctcgcggtgtcctctgtgggggcatttacgcacatcatcgttatcgcttgcactacaagcacaccgcttgcgtcgcgcccgacccctattggatccacggtcgtattgcgccctcagcttcctcggctctcgtgcatgggtgctacgacgtcgagcggttagcctgctctctcgtttgaggtcttttaggcagccagttgcctggtccttgtgctcataccactttgggtgtgtctgtgtctgtgtctgtgtctatgtctgtgtgcacgctcgtgtcatggatagagggctggattatagttcgaggccaggtgtggagtggatgcttccttcatgtgccggagtacaaaagcgccgtgcaccagacgaggagacagcaaaaactttttttttttactttgtcaagaaggcaggacaggaatattgagagcgtctttggcaagctatgcactggagactaatttttctataaagcgaccgagcatctggcatgccagccgccctctcgtccctcgtcctttttctcctctctttcagtgctcctcggtctcgcttcgcttgtctccctcagctgtctgccatctcccattgcgcctcccttcgtcttcccatccgccttccctctcgccctccatcgcagctgcccctctcctctcgcccacctgcctgacccgctgtcgctggtgcgcgtgcgtcgagtctcattcccccgtcctctagaacccgcttccaattcagcgcaatccactgcaccgtcttccatcctcacgatcaacatctctgcaatcactctcagcactcccagtcctcattcctgcctctcttcatcccctcctagctttatttattgctcgatataccacgcctcggctgcctcttgacgacctgcacgatggaagctgtacgctcagagccgcactcgctcctgccagttgcccacaatacccccgtcgccccagaaggtgccaccacaggagccgtgtccctgaaggcctcgcctagcatcaacggcaagtggctggctttatctcttcttagattcttatgctcagcttgtagctgaaccaagctcgaagggctgcacgggcctccagctctctcgtctcatttattgattacattaagacttatacttctttggcttggtcatgttcacttaacaggaccttgctccaacccacaacaggcaccccgtcggtccgacagcggcgcatcattcctaagccaggccacaagcatcggactttgtgttgagtgtacgttacggcctgctttgttccctagctcgtatgaaccttgtcttaccacgtttgttgctgatcaattttgctacggcatttcgtttatccccggatgacttacattatcccgcccggtcaacagtggtgcctggtatgtacaaataccgctgaactgccacaggactgctgcgtccagctagagtcttgaccttgccctttagcccgagcatttctgcaccttgcctgcgcacattgatgacagcctgcgcagctagactaaaacagccgttttcaatgttgtagaatacatctccttccgccttcgcagcgtctcctgcatcggtctccataacaagactcaagtcaggctcaagcttcagaacgtttcccagagcacgaagcctgccaagaatctcggcgaccatacccaccaggcttttgactttcagacgactgttcacaacatgacgttcgacactgtcaagatcgatgtcttcgatatcaggaaggggcttggccaaaacgtcaaaattgggcgcgcatacctttcgttgcgtgatttacagaaaaaggtcggcaacgcctacgacaacgacggcgatgacaatacggagcctgagcagtctgtgctttcagcgcgattcgatgccacagccttttgccagaagcacgacgatatctttgaggtcgatctcccgctttacaagcatgggtcctactccaagttcagttctgtcagccacagccacggacagcataacggcgagaatgtgatcattaccaaaggatcggagcgcggtcaggatgtctctgctctcgaccgccgtcgtccgctaatacggtcccagtcgtttgcacaggacgttatgaacggagtggaggtcggcatgatcaccgttcaggccattcttcacttcaaagaccagactcagaatccgctgttcgcgcacctgggcaaggggactggccagccaggcgcagttggccggggcgccgccgtcacaggacctagcactgttggaaacatgcagcaacagacgccattgcggaaatcgagaacgcaatcgcaccggtccatggactcttccaattccacggattcatctacactgggcgacaaccatctcaccactaacgactacttttcggaccagagccacgcgttctcatcatcaagcgagcaagaactcgccactagtccgcctgcagcaccatccgcgcctgtgagcctgcgaaggccgtcgcaggcaggcgaacagccaatctcgtcaaggatcttattgacaccttcgtcacctcccaatctgtcacgtcactatggcgccgggtcttcgaactcgccaccattgtctccgagctcttcccattccacaggagcgcccaacctcacgagtgctgagagcagacctcagctaagcggtttctcgtctttggaggagtcaaactcacgctacggtgatgatttcatcaacagcgatgatgctgactatgacgacaatgcgcagagcgcgagaggagatcaggatcagatcaagggcgaaaatttgacgcaggccgatcgggaccgtgaggaagagttgatggccaacatcatggcgaacggcaaccaggtcaagaaagaaatttatctgaatcgatcccatgaggaacacaagcagcacgccaagggcaagaaagccaagttcaactttttctctgagcagacacgatccgccttcaaggacattcagcttatgtatagctccttctttggtcatggctggaacctatcgcgctccgagttttggaggggttttcacattgtcgagcagttctatgcgcgcaatcccacgtaagtcaaatctgtgtcacatatcatttatttttgtctgttgacatttgttaacccagtctttcaactctgcagccccactaccaaccgcgctttcgacaacattgagattctagagcatgcgcgccattttgtccgtctcgcgattgcatcatatggctctctcccgtgggtctactttggttacagtttcaaggttgcgccattgagtaagctttatgatgggggaattgactcgattcagattctgctgatcggtgagcgtgcacacagggcctgacattcgtgccctctgtttccgcgtagattttgtgcggttcaactctgatcgcaagaacgtgcaagattatttcaagctcaacaaggaggacatgatagtgtggcatttcgacaagaggacggcccttgtaccaagctattacattgttcgagacccaaagtataatgcactttgcattatcatccgcggcacctttgtaaatccctacatctttggtaccgctcgaaagcagaaatgttgactttattggtcgcgccttactgaccttcataacatgtcctgaaatcgcttctactactagagcatcacggatgcgatgacggatttggtgtgcgagtattacccttacaaaggaggacttgttcacaaaggaattatggacaacgctcgattcgtgctcgagcgcagtggcaaagatatcgaggctgctctgagaaagtttaatctcaagacattgtactggtaagcgtgcgaatttttttttggatatgacgcctcgtgtcttagcctccttcctaacgcgctcagtacttgcatttaattcttatccaacagtatcggacattcgctcggggcaggctccgcatccttgctttgctctctccttcaggatcactttgcggactatgtcacagaagccacatcagaaagcccggcacaaaagctggaggtcaaggcttacctttttgcccccccaccgatctgtacgcctaatctagcggcagaatgggagcggactcagattgctttcatcaacgagaacgacattgtctgtcgcatgagctatggaaacgccttggacctgaaggaactcatcaagataggggccatcgagtcgctgaacccagcatatgatggcctgaatcccaaggaaaagctggaccgcatcatcaaggtcttggagaaggcgcaagagcgcctgcgcgccgtagacgacgttcctcgcctagtgacagcaggcacagtcacctatatccacaagatttatgaggatacgcccgtggtgcagaacaggaacaacgggcgcgacagcaagttcggactgccagagacgtggtcggacgagacggcggacaaggatgtgcagggacaaggtttgcatggtcaaggtttgcagggccatgctgctggacgaacacgaggaatgagcacgagctccgtttccacgaaccatagtactcagagcaacttgtcgcggtcgctctctgccattacagcggcgctgagcctcaagaacaatgcagccaagcgccacgagacggcccctgcagccgctacaagtataggaggtgacaatagtctacgtgctccaaaggtcacgccctaccagcccaatcaaccgcctgtccgactcgaaagctccgctagccttgcgctgtctgacctgaacgagggacacctgccgccgtttgtcgtgcccactccgcctacggtggaaagcccatcagagtcgccctcactgacaaggacaattggtcagcccatccagttcaagggtgcgtcgaatgcgcgtgaattggcaacagcgagcattctgggtcagagcctcggcggtggcattgcggatgcgagtgaaaatcacgtgcagcagtcttttggacttggtgagggagagcttcagggtcaacgacaaaagggcgatcgtcaatttaaccaggacgagagggaggaagagaacgaggctgatgaagaagaagaggacgagggcgaggatgaggatgacgagtatgatgaggataagcacaaggtattcacgaccaagaagccgcgcaagaatgggtctaagaagaaggagatccgtatcgagttttcggacaaggccgcgtttatggcgatcccgttgagggctaactggctgtggcaccacttcccgcagcagtacgactcgaggatagagcgtgccctggcctgggccacggctcacaagaagaaggaggagcgcagacaacagctccgcgcccagaggcagcagcagaaaaaagcgcgtaacgactgagcatatgtagtgtaaagcagccagaggcaaatgaaaaggactcactcccgcgcgtcattacaatgtgtagagcgcgcggcgtaatccacaacaaaaacaaacaaaaaaaacatttctctgagcagtgagcctggcagctggcgaataagggtgggcggtggcttgctttggctctgttcaaatgaactgacgctgtgcctcggttggctcgtttatacacgctcgttttccgtcgtccctcttctttccccttttcttcttcactctccactcgtttctctgttcttgcctcccttcttcgacaccttcactggcgccattctgtacatatccttgatccttatttgtggacatccttcaagaaaaaaaaacctttcgctctctctcgctctctctctccttcgcctcgccctttgtttgccatatagccttccttttgtccgttcaggctgcctctttgcaccatatcatatttgactcgcctcgtctactagttttttttacaccctcatcatggcttccgctgttccttcgctctctaacgaggcacactactatgagtacacggctctctttgaccgacataattctgctcattcagcattggacgacgcatcagcacattcaaccgaggctttgtcggacgacccgtggagaaacgccgccaaatcaagcgctggtctgggctcagagggaatttccgcactttggtctggctccgtccaaggtcgtttgacgtttctcgaacccgaccaagagtcgaaaagctcccactcagatgcgcatccatcaccgtcctcaaccgccttcacgcccgcaagcacgccctgctccgagtctgacgactctgctctgatcgactcgttgagtccgcctctgtctccctggtttccctcggtggctcagatcgcaaatgatcatcccattctgagcaaggacgatcttggaacagtcaacacctccgagctttttgccgccgcctctggtgttgatcttgaattcttcaacaactcgttttatcagagtcttcgcaaccactcctctcgccagcgcaagacgtctgtcgcttatgctgttcgagattcagtcagaggtcggacaaccacagacaaccatggcactgcagcaccttcggatctctttagcgtcactattgatcaaatcctttctgcagatccgttggactttgagctgctggacactgccatttccgagacgagtgagatcgctcatttagaggctgcagacactgagcaggagctagggactcggtccagcatcgagtctggtgaaagcttgttcactcaggatcatgccttgagcgaagtagattcagccagtactcaggagcaggagatggacgatcaaaacgactcggattatacagagccttcctccaaaagacaacgagcccctgcagccagcatggcatcacaagccaattctacccgccgccgctcgacgaagggcaaagcaccacgtgtcaagaaggcgccgatcaagaaggctcctaaagtatacccacaacgtcgaaccaagaaccatgtccatggtgataataataaggacgatcatgcgtcacagttgtcgctcgggtctctgtccctgtcacgcacctcctctccagcgtgggactttgatagcaagggtccgatgccggcagtcgaggcaggcgatggtggttacctttgcaagcactgcccgcaggaacggttcggacgcgtccatgacctgaagcggcaccaaatctccaagcacaacgagaggacctggccctgcgacttttgtcatcgtccattcgttagacgcgatgctctactgagacactacaccgtcaaggctgcacgaaatgatggcattcacccaagctcacaagaaacgtgtcgtttgtcggaggcaagagcaagagcaaagctgatttagttttcagatgcagttttatacagaaacgaattcttttttttttttt

SEQ ID NO: 8-94 - skipped (87 entries)

SEQ ID NO: 95 - DNA, 12823 bp, Artificial Sequence
  Synthetic construct
ggtaccggcctcatacttcttctatgacgctagccgagagcagcttgaagaactagtggccctgtacccagactccaccacgtacgggtctccgttcaggacaggcgcggccaacaactggtatccgcaatttaagcgattggccgccattctcggcgacttggtcttcaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaatgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcgcatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattagacgggttcgcataggtttggggttgtatcttggcgttgggacggactgggtatggtgtttcttttggatatatgacatgatatgtacaggccgtgaatctttaactttatatcattatagaaatgcacttgcacatttcaacacgctgcgagcagaatctcgaagattgttccgcaagtattagatcatgagagcattatcatttcctttcaggcagtgggagtaggccatcctgaaaacaaggcggccactgtagactagagaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctg

SEQ ID NO: 96 - DNA, 20 bp, Artificial Sequence
  Synthetic construct
cggatcgatgtacacaaccg

SEQ ID NO: 97 - DNA, 43 bp, Artificial Sequence
  Synthetic construct
agtatacaaaaaataagcttcaacaggaggcggatggatatac

SEQ ID NO: 98 - DNA, 5369 bp, Artificial Sequence
  Synthetic construct
cattttgacggtggatgtagaacttgtcggatcgagatgggaagttgaaaaatcgaggtggaatcttgtagggggggtttgactgagtcaccactttgcgctgagcatctgtgggcgaatcgcgctagtgctgacctgtaagcgagatggcaaattcggcagggcggaaagcggctgagtcagcaggcaacagtgtcgcttcgtcacttcactggacacggcctgaggcagtgaattgccacttgagaagttttgtccctgaggtcttgggagggcgctttatggaggcagtgtccttataattttttattctacttgcttattggtcttatgtttgcctacttatcaatatcagcgtactctgctgatacttggaagttcttttgtctgaactcagacgcggacgacgaattaggttagcctaggtttgtgccctattccgggacaggactctggagcgcggaggctcaacggggcggtatatggattttaggtcaagccgccgcgttatgggagacttgcgtcaattgatcactcaggtccatggcattcccccatcttatggagaagtacaaggttgctgccgataacagcaccctcgtattaattgcacattgactgggcgtctacggagtctcaagcccaggcatatcaattaacagtcgacccctggaatatctggatgcgcatggagtgaacagcaagatcatgtaggaattacactagcacgatatatcccgcggccatctggatcttcattcatgcatccgtggcgcgattgatagagcttatctgagagccgttaaacccgtaagaggccgtcttgcacgccgatagttttggaacatttcatttttggtggtagggaaaacacatattccagctccagtaacctcccaaaattcgtccatgaaactcttgccttccgcacccaatcccaagccgaaccgttattcattccttaacgagacttggcagcgaccttgggagcagaacccttagcaccctgcttgctctggatgcgctgagcagcacccttggcaccagcagcggcgttcttagccttctcagccttcttcttggactcagcggcagccttcttctccttggcgtccttgatggcctgctggcgggcggcggcacgggcctcggggcgctgggagcggcgctccttgatcacgtcgagggaagcaccgacgatggcacgctgggacttgacgacacggcgggtacgcttcttggcaacctcctgttcgtgttgaaatcaatggtcagcattctgttttcgatgccaccaatgttatccgcaaaacactttcggaatgttccatctcttcacgacccatagtatcggccgaggggtaaaccattcgcagtccccagatgtatcattccaactgcgaaaatcgaatccagtggtaaagaaaaggcggtacggacctcagagatacccttcttgtgctggcgacggtaaaggacagtccaagctatccggcgagggcactgctaagatttgtgttcgtttgggtgcagtcggttgtgtacatcgatccgccccacttcagaagttcctatactttctagagaataggaacttcactatagagtcgaataagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatggggtcaggtgggaccaccgcgctactgccgccaggcaaacaaggggtgttatgagccatattcaggtataaatgggctcgcgataatgttcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaaaagcagagcattacgctgacttgacgggacggcgcaagctcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaggcgagagtagggaactgccaggcatcaaactaagcagaaggcccctgacggatggcctttttgcgtttctacaaactctttctgtgttgtaaaacgacggccagtcttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatatcaaaattatacatgtcaacgataatacaaaatataatacaaactataagatgttatcagtatttattatgcatttagaataaattttgtgtcgcccttattcgactcactatagaagttcctattctctagaaagtataggaacttcacttcattttcaacaggaggcggatggatatactgtggtctggaagatgccggaaagcgtgaggcacactatcccttaagcacgcaagcaagcaaaaataaaccgagaagaccgcgaatccattcaacaactcatttggtatttaaatggatagatggatggtagggtatgtataacaaaatcgacccgtgccatattccaccccttgtccttgttcgatggacttcctccagcccagctcagcccagtccattcgtccgcgaccgcaaccgtaaccgtaccgcagagcccgcgctttatcaattcattcccagaatcattttcgctttttttcgtttcagtcaatcgcaacgcaaaccatttatttatagtttcgacttgtacagctcatccattccgtgggtcaggaagaggtggtggcggccctcagcacgctcgtactgctcaacaatggtgtagtcttcgttgtgggaggtgatgtcaagcttggagtccacgtagtagtatccgggcagctgcacaggcttcttggccatgtagatggacttgaactcaacaaggtagtgaccaccgtccttgagcttgagagccttgtggatctcacccttgagaacaccgtcacgggggtacagacgctcagtcgacgcttcccagcccatggtcttcttctgcatgacagggccgtcggaggggaagttgacaccaatgaacttgaccttgtagatgaaagagccatcctgcaagctgctgtcctgagtaacggtcacaacaccaccatcctcgaagttcatgacacgctcccacttgaaaccctcggggaaagaaagcttcttgtagtcggggatgtcggcggggtgcttgacgtagaccttggagccgtactggaactgaggagacaggatatcccaagcgaaggggagaggaccacccttggtgaccttgagcttggcagtctgggtgccttcgtaggggcggccctcaccctcaccctcaatctcgaactcgtggccgttgacggatccttccatgcggaccttgaagcgcatgaactccttgatgacatcttcgctggaggc

SEQ ID NO: 99 - DNA, 39 bp, Artificial Sequence
  Synthetic construct
ggaacaaaagctgggtaccttgcccatcgaacgtacaag

SEQ ID NO: 100 - DNA, 23 bp, Artificial Sequence
  Synthetic construct
tgctaagatttgtgttcgtttgg

SEQ ID NO: 101 - DNA, 3506 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcaaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 102 - DNA, 13672 bp, Artificial Sequence
  Synthetic construct
ggtaccttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctg

SEQ ID NO: 103 - DNA, 821 bp, Artificial Sequence
  Synthetic construct
ggtctcggtgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatgggagacc

SEQ ID NO: 104 - DNA, 4156 bp, Artificial Sequence
  Synthetic construct
ggtctcgaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaaggagacc

SEQ ID NO: 105 - DNA, 321 bp, Artificial Sequence
  Synthetic construct
ggtctcgtaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcggagacc

SEQ ID NO: 106 - DNA, 3506 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagcgacttccaatcgctttgcatatccagtaccacacccacaggcgtttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctcttgcccatcgaacgtacaagtactcctctgttctctccttcctttgctttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 107 - DNA, 8417 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagcgacttccaatcgctttgcatatccagtaccacacccacaggcgtttgtgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcttgcccatcgaacgtacaagtactcctctgttctctccttcctttgctttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 108 - DNA, 52 bp, Artificial Sequence
  Synthetic construct
ccctcactaaagggaacaaaagctgggtacgcaactctctggaaatgaaggc

SEQ ID NO: 109 - DNA, 55 bp, Artificial Sequence
  Synthetic construct
gagtacttgtacgttcgatgggcaaggtacgaggttcatggtatgggcacgaatg

SEQ ID NO: 110 - DNA, 19242 bp, Artificial Sequence
  Synthetic construct
cttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 111 - DNA, 1518 bp, Artificial Sequence
  Synthetic construct
ggtctcggtgcacttttttggtcctgattgaaaatggtagcgtggtctaggagaggtgaaggaagatctagcactgcttgataacgggtgcaattgtccagtaaagaaaggcgtgcctatcgtgcgattgaaacagagagcggatgatatgtggcggatctcccagtacaaggcatgttacatctctcccctagtcgtaattgcaaggatcaaacgttgggtcaatggaattcagagagcttttcgtacgaagtgcgtaatgtacgtagcattttatggtagcatgcaaagcacattttgctgcaaccccaatttaatgcggtcctgctcaataattgatctgcactaaggccttggcgatggggccagaaaagggttgttcagtggtgtgtactccgtaatggtcaagccgatttcgagaatgaccgtagtgttcattcatcagtgcgatattaaatcagttagctactctatctgaaagctaataaatttctttaccactaacaatactcttctctgactgaaagtaccttttccactcccctcatacttcatgttttaagctcaaccgtaggaaagcctgtatatcttaaaagatttggatttactcttccagcgcttactgtctgctctttcggccgagcgaaccttggcagtatgatcggactatgtactttgttacacaaaaggagaagcggggctgccactgaggacaacccctgttcaagggctagcatcccgctgtaagcccacccatcccaccttgaagtatgcaacttttgaccgcctagaccatgtgagcttatgttactgaaatactacccgcgaatcatttcctaatttgctttggctcgaatccaccccagccctacgtaacacaaccgggagctgccttacagcttggctgtatcacagtatcacatagatacatacatagtatagtgcctttgccttttcgacctataagcatccgccatatgctaaaccttctcatataccaacattttggatttggagatcatttcctagtgaaacaactttatcaaatgcaatgcagccatcgtcctttgcagatccgagtggcccagtcaccgtgtcaacgtgtcagccgttttctctgctttttaggaaatgattaccactaggtaagcccaaaaatatcttcctggtaaacaagtagtgcatcttaccccggaggctgaagcaggtaagggattttggagagagcccacccgtaagaatataccagccaagaggtccagtatcctgaagtatgtgaggcattaatgtcattggagaagtcatgcaatccataagctgccacccccaagatgactgcattggacctgagcattgtatgtgtcacctttcacacagagctcatgatctggtttataaaggcggcttcatgaccctcaattccatatagtatcactcccatcacagcatttcgatatcttcaaccactttaaccttctccagaggatcatcatctcaacaccgtcaaaatgggagacc

SEQ ID NO: 112 - DNA, 654 bp, Artificial Sequence
  Synthetic construct
ggtctcggtgcggtcgggaagaaaggatgagcaattgaggctcaatctgcaacaatgacaatctagaagcagcaaacagatgtgctgacctccatctatgtgcaggactggtcagacaccacctgtgcagcgttgcacgttcggtccagctggccagataagcttggctgggcgagtggccggagcaacctggggcagcggggccgctaagccagccctgactattagggcatccagctgtggctgaggcagacactagcagctggccaagagtttctgtttacacacaaggacacaggtgttgctttgtgttacaatataatatattgcaaaagatcagttgttaaaaagagatacacgtgtatatcgtgtcgaactctccagaagtcttttctttcccctcaggcagcaaaaagagagcgagatgcagccttctggcagcgtctggacccggcattggcccgtccacggcgacaaccaggggatggagaacccctccagccccaccatctggctgtccgagtcgaatatattttcgccaacgcagcccgccagagtctgctcttatcttcaatcccccgtgtcctcgagttcgcagcagtctccttgacctggagtccgcaatctctctcaccaccgtcaaaatgggagacc

SEQ ID NO: 113 - DNA, 322 bp, Artificial Sequence
  Synthetic construct
ggtctcgtaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctcggagacc

SEQ ID NO: 114 - DNA, 333 bp, Artificial Sequence
  Synthetic construct
agtatccgtttgtctcccagattcttgccagttccgaatttcgcaagcgaggtctcgaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagaccaaactgccgtgtcggacttctctgcaacttgtgtatctgctccaaagccc

SEQ ID NO: 115 - DNA, 20608 bp, Artificial Sequence
  Synthetic construct
cttgcccatcgaacgtacaagtactcctctgttctctccttcctttgctttgtgcacttttttggtcctgattgaaaatggtagcgtggtctaggagaggtgaaggaagatctagcactgcttgataacgggtgcaattgtccagtaaagaaaggcgtgcctatcgtgcgattgaaacagagagcggatgatatgtggcggatctcccagtacaaggcatgttacatctctcccctagtcgtaattgcaaggatcaaacgttgggtcaatggaattcagagagcttttcgtacgaagtgcgtaatgtacgtagcattttatggtagcatgcaaagcacattttgctgcaaccccaatttaatgcggtcctgctcaataattgatctgcactaaggccttggcgatggggccagaaaagggttgttcagtggtgtgtactccgtaatggtcaagccgatttcgagaatgaccgtagtgttcattcatcagtgcgatattaaatcagttagctactctatctgaaagctaataaatttctttaccactaacaatactcttctctgactgaaagtaccttttccactcccctcatacttcatgttttaagctcaaccgtaggaaagcctgtatatcttaaaagatttggatttactcttccagcgcttactgtctgctctttcggccgagcgaaccttggcagtatgatcggactatgtactttgttacacaaaaggagaagcggggctgccactgaggacaacccctgttcaagggctagcatcccgctgtaagcccacccatcccaccttgaagtatgcaacttttgaccgcctagaccatgtgagcttatgttactgaaatactacccgcgaatcatttcctaatttgctttggctcgaatccaccccagccctacgtaacacaaccgggagctgccttacagcttggctgtatcacagtatcacatagatacatacatagtatagtgcctttgccttttcgacctataagcatccgccatatgctaaaccttctcatataccaacattttggatttggagatcatttcctagtgaaacaactttatcaaatgcaatgcagccatcgtcctttgcagatccgagtggcccagtcaccgtgtcaacgtgtcagccgttttctctgctttttaggaaatgattaccactaggtaagcccaaaaatatcttcctggtaaacaagtagtgcatcttaccccggaggctgaagcaggtaagggattttggagagagcccacccgtaagaatataccagccaagaggtccagtatcctgaagtatgtgaggcattaatgtcattggagaagtcatgcaatccataagctgccacccccaagatgactgcattggacctgagcattgtatgtgtcacctttcacacagagctcatgatctggtttataaaggcggcttcatgaccctcaattccatatagtatcactcccatcacagcatttcgatatcttcaaccactttaaccttctccagaggatcatcatctcaacaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 116 - DNA, 19744 bp, Artificial Sequence
  Synthetic construct
cttgcccatcgaacgtacaagtactcctctgttctctccttcctttgctttgtgcggtcgggaagaaaggatgagcaattgaggctcaatctgcaacaatgacaatctagaagcagcaaacagatgtgctgacctccatctatgtgcaggactggtcagacaccacctgtgcagcgttgcacgttcggtccagctggccagataagcttggctgggcgagtggccggagcaacctggggcagcggggccgctaagccagccctgactattagggcatccagctgtggctgaggcagacactagcagctggccaagagtttctgtttacacacaaggacacaggtgttgctttgtgttacaatataatatattgcaaaagatcagttgttaaaaagagatacacgtgtatatcgtgtcgaactctccagaagtcttttctttcccctcaggcagcaaaaagagagcgagatgcagccttctggcagcgtctggacccggcattggcccgtccacggcgacaaccaggggatggagaacccctccagccccaccatctggctgtccgagtcgaatatattttcgccaacgcagcccgccagagtctgctcttatcttcaatcccccgtgtcctcgagttcgcagcagtctccttgacctggagtccgcaatctctctcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 117 - DNA, 20 bp, Artificial Sequence
  Synthetic construct
ttgcccatcgaacgtacaag

SEQ ID NO: 118 - DNA, 23 bp, Artificial Sequence
  Synthetic construct
tgctaagatttgtgttcgtttgg

SEQ ID NO: 119 - DNA, 998 bp, Artificial Sequence
  Synthetic construct
caactggaagcaatatcaccaggactttagctcctctctccaggtcctccgcctcccagcctacaagtgggatctcaagaactactggattccctataccaacaacttctgcctgagcaagggcgctccagttgcgacagtagcggcagggccacagcatgagtacctgacaaccgcggctcagaaggtcattgagactcgaagtgatggagcaacagctacagtcgtgatagagaacgacattgctgatcccgagctcaaccgcgtcattcaaggccataaggtcaacggtactgctttgtgtccctcatcactatatgccgacatctctcaaacgcttgcagagtatctcatcaaaaagtacaagcctgagtacgacggacttggactggatgtgtgtgaggtcacagtgccacgaccactgattgcgaaaggcggacagcagctctttagagtatctgcgacagcggattgggcggagaagaagacaacccatatattcagtcactgccgaggggaagaagacggctgaccacgcaacttgcactgtccgattctttgactgcgctgctgcggaggcggaatggaaacgagtttcctaccttgtcaagaggagcattgaccgactgcatgatatcgccgaaaatggtgacgctcaccgtcttggtagaggcatggtttacaaactcttcgctgccttggttgattatgacgacaacttcaagtccattcgcgaggttattcttgacagtgaacagcacgaagcgactgcacgcgtcaagttccaagcaccacaaggcaatttccaccgaaacccgttctggattgacagttttggacacctgtctgggttcatcatgaacgcaagcgatgcaaccgactccaagaaccaggtctttgtcaatcacggatgggactccatgcgttgtttgaagaagttctcgcctgatgtcacctacaggacttatgttagaatgcagccttggaaagactccatc

SEQ ID NO: 120 - DNA, 23 bp, Artificial Sequence
  Synthetic construct
caactggaagcaatatcaccagg

SEQ ID NO: 121 - DNA, 21 bp, Artificial Sequence
  Synthetic construct
gatggagtctttccaaggctg

SEQ ID NO: 122 - DNA, 23 bp, Artificial Sequence
  Synthetic product
gagccttcatctggcgggtattg

SEQ ID NO: 123 - DNA, 23 bp, Artificial Sequence
  Synthetic construct
caactggaggtaggaccgtatcg

SEQ ID NO: 124 - DNA, 22 bp, Artificial Sequence
  Synthetic construct
gtactgctttgtgtccctcatc

SEQ ID NO: 125 - DNA, 8097 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagcgacttccaatcgctttgcatatccagtaccacacccacaggcgtttgtgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcttgcccatcgaacgtacaagtactcctctgttctctccttcctttgctttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 126 - DNA, 18900 bp, Artificial Sequence
  Synthetic construct
cttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgt

SEQ ID NO: 127 - DNA, 1003 bp, Artificial Sequence
  Artificial sequence
gtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaa

SEQ ID NO: 128 - DNA, 19791 bp, Artificial Sequence
  Synthetic construct
cttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 129 - DNA, 4517 bp, Artificial Sequence
  Synthetic construct
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttcaactggaagcaatatcaccaggactttagctcctctctccaggtcctccgcctcccagcctacaagtgggatctcaagaactactggattccctataccaacaacttctgcctgagcaagggcgctccagttgcgacagtagcggcagggccacagcatgagtacctgacaaccgcggctcagaaggtcattgagactcgaagtgatggagcaacagctacagtcgtgatagagaacgacattgctgatcccgagctcaaccgcgtcattcaaggccataaggtcaacggtactgctttgtgtccctcatcactatatgccgacatctctcaaacgcttgcagagtatctcatcaaaaagtacaagcctgagtacgacggacttggactggatgtgtgtgaggtcacagtgccacgaccactgattgcgaaaggcggacagcagctctttagagtatctgcgacagcggattgggcggagaagaagacaacccatatattcagtcactgccgaggggaagaagacggctgaccacgcaacttgcactgtccgattctttgactgcgctgctgcggaggcggaatggaaacgagtttcctaccttgtcaagaggagcattgaccgactgcatgatatcgccgaaaatggtgacgctcaccgtcttggtagaggcatggtttacaaactcttcgctgccttggttgattatgacgacaacttcaagtccattcgcgaggttattcttgacagtgaacagcacgaagcgactgcacgcgtcaagttccaagcaccacaaggcaatttccaccgaaacccgttctggattgacagttttggacacctgtctgggttcatcatgaacgcaagcgatgcaaccgactccaagaaccaggtctttgtcaatcacggatgggactccatgcgttgtttgaagaagttctcgcctgatgtcacctacaggacttatgttagaatgcagccttggaaagactccatcaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 130 - DNA, 1141 bp, Artificial Sequence
  Synthetic construct
ggtctcggtgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatgggagacc

SEQ ID NO: 131 - DNA, 19911 bp, Artificial Sequence
  Synthetic construct
cttgcccatcgaacgtacaagtactcctctgttctctccttcctttgctttgtgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 132 - DNA, 10676 bp, Artificial Sequence
  Synthetic construct
aacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtaccttgcccatcgaacgtacaagtactcctctgttctctccttcctttgcttt

SEQ ID NO: 133 - DNA, 21 bp, Artificial Sequence
  Synthetic construct
gcaagaaccgtatctgctacc

SEQ ID NO: 134 - DNA, 21 bp, Artificial Sequence
  Synthetic construct
gagaggttcttggcagctagg

SEQ ID NO: 135 - DNA, 13468 bp, Artificial Sequence
  Synthetic construct
ggtaccggcctcatacttcttctatgacgctagccgagagcagcttgaagaactagtggccctgtacccagactccaccacgtacgggtctccgttcaggacaggcgcggccaacaactggtatccgcaatttaagcgattggccgccattctcggcgacttggtcttcaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaatgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcgcatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattagacgggttcgcataggtttggggttgtatcttggcgttgggacggactgggtatggtgtttcttttggatatatgacatgatatgtacaggccgtgaatctttaactttatatcattatagaaatgcacttgcacatttcaacacgctgcgagcagaatctcgaagattgttccgcaagtattagatcatgagagcattatcatttcctttcaggcagtgggagtaggccatcctgaaaacaaggcggccactgtagactagagaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctg

SEQ ID NO: 136 - DNA, 14317 bp, Artificial Sequence
  Synthetic construct
ggtaccttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctg

SEQ ID NO: 137 - DNA, 15186 bp, Artificial Sequence
  Synthetic construct
ggtaccttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctg

SEQ ID NO: 138 - DNA, 1626 bp, Artificial Sequence
  Synthetic construct
ttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagca

SEQ ID NO: 139 - DNA, 21 bp, Artificial Sequence
  Synthetic construct
ctaaactgggcttgactcagg

SEQ ID NO: 140 - DNA, 21 bp, Artificial Sequence
  Synthetic construct
caccgacgatggcacgctggg

SEQ ID NO: 141 - DNA, 23 bp, Artificial Sequence
  Synthetic construct
caacaggaggcggatggatatac

SEQ ID NO: 142 - DNA, 3539 bp, Artificial Sequence
  Synthetic construct
  misc_feature (2631)..(2631): n is a, c, g, or t
gcgtcgggatgatgagatgagctcgagtgaaggcgagggcatttacgttgacattgaggtttgagcctagccttgggggatgaaaggacggtcgtggagacggtcgtgggccatggtcgttgggcatattgggcgttccagggcaaggcttgcgtgtgctattcttttgaaggatgttctagtccaccttgtgttcataagggctcttttgatgttcctatcattgcatgtatcatatacccttcggttcattcttcggttcgtcttctttcttggacatttgccgtgtgggcattgtgcattgaacgcgttggttaagccagatagcaatggcaccgagacacatgtacataaacatgcaggatgattgttttgattttgggcacagctagccgtaggctgcgtcttcattcgaagtaatacaacagtctagcaagtaggatatacacatcacgtcacacacatcatcacatcataaagatccacctaccgttcgtatagcatacattatacgaagttatggcgcgccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgactaacagctaccccgcttgagcagacatcaccatgcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgcgggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgttttcgggtttacctcttccagatacagctcatctgcaatgcattaatgcattgactgcaacctagtaacgccttncaggctccggcgaagagaagaatagcttagcagagctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagccctgggttcgcaaagataattgcatgtttcttccttgaactctcaagcctacaggacacacattcatcgtaggtataaacctcgaaatcattcctactaagatggtatacaatagtaaccatgcatggttgcctagtgaatgctccgtaacacccaatacgccggccggccataacttcgtatagcatacattatacgaacggtagggttgaagggtgtgtagactgatgatggatatatggaagctggaggatgaaaccgaaccccacgcggggcacctcggagtttcggagcgttggatcgggaccctccgggttgggttcgtgtctaatggtcatgtgatttgtatacacagggagttaatcttcatttttaggtattgtgtatagtgacaattaacgatggatgattgtttactgtaaataattatacgttttacatgattcaaggtgaaactcgttttgtaccagatactcacaaccacattaataatgggtggaagtatactccccgtcattggcatccccgaatgcagcaggcaaagtaagtatgaatacgaacacgaagtcgacgacatccaacccatggaccaactaccagtgatacgcaacctgtctactaagcacagctaccgtggctagactgggccttgccatcgatccgagcacataaagtctcagaagtcgtcgtgtttactggac

SEQ ID NO: 143 - DNA, 21 bp, Artificial Sequence
  Synthetic construct
gcgtcgggatgatgagatgag

SEQ ID NO: 144 - DNA, 22 bp, Artificial Sequence
  Synthetic construct
gtccagtaaacacgacgacttc

SEQ ID NO: 145 - DNA, 241 bp, Artificial Sequence
  Synthetic construct
ggggggtctcgaatgaagagactgatgagtccgtgaggacgaaacgagtaagctcgtctctctttgaaggtgtcgttggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagaccgggg

SEQ ID NO: 146 - DNA, 19791 bp, Artificial Sequence
  Synthetic construct
cttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgaagagactgatgagtccgtgaggacgaaacgagtaagctcgtctctctttgaaggtgtcgttggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 147 - DNA, 241 bp, Artificial Sequence
  Synthetic construct
ggggggtctcgaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggacgggtggagaccgggg

SEQ ID NO: 148 - DNA, 241 bp, Artificial Sequence
  Synthetic construct
ggggggtctcggggtaagagactgatgagtccgtgaggacgaaacgagtaagctcgtctctctttgaaggtgtcgttggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagaccgggg

SEQ ID NO: 149 - DNA, 20006 bp, Artificial Sequence
  Synthetic construct
cttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggacgggtaagagactgatgagtccgtgaggacgaaacgagtaagctcgtctctctttgaaggtgtcgttggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 150 - DNA, 241 bp, Artificial Sequence; identical to SEQ ID NO: 148
  Synthetic construct

SEQ ID NO: 151 - DNA, 21 bp, Artificial Sequence
  Synthetic construct
acagtcttgcgagccttcatc

SEQ ID NO: 152 - DNA, 20031 bp, Artificial Sequence
  Synthetic construct
cttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatgatctgactgatgagtccgtgaggacgaaacgagtaagctcgtctcagatatattcagtcactggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggacagtatccgtttgtctcccagattcttgccagttccgaatttcgcaagcgagggtaagagactgatgagtccgtgaggacgaaacgagtaagctcgtctctctttgaaggtgtcgttggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtcctgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 153 - DNA, 21 bp, Artificial Sequence
  Synthetic construct
gccacagcatgagtacctgac

SEQ ID NO: 154 - DNA, 21 bp, Artificial Sequence
  Synthetic construct
gcgttcatgatgaacccagac

SEQ ID NO: 155 - DNA, 21 bp, Artificial Sequence
  Synthetic construct
attgctgatcccgagctcaac

SEQ ID NO: 156 - DNA, 21 bp, Artificial Sequence
  Synthetic construct
cgcttcgtgctgttcactgtc

SEQ ID NO: 157 - DNA, 21 bp, Artificial Sequence
  Synthetic construct
gagtacgacggacttggactg

SEQ ID NO: 158 - DNA, 21 bp, Artificial Sequence
  Synthetic construct
tcggcgatatcatgcagtcgg

SEQ ID NO: 159 - DNA, 21 bp, Artificial Sequence
  Synthetic construct
aggcggacagcagctctttag

SEQ ID NO: 160 - DNA, 21 bp, Artificial Sequence
  Synthetic construct
cagtgcaagttgcgtggtcag

SEQ ID NO: 161 - DNA, 715 bp, Artificial Sequence
  Synthetic construct
gccacagcatgagtacctgacaaccgcggctcagaaggtcattgagactcgaagtgatggagcaacagctacagtcgtgatagagaacgacattgctgatcccgagctcaaccgcgtcattcaaggccataaggtcaacggtactgctttgtgtccctcatcactatatgccgacatctctcaaacgcttgcagagtatctcatcaaaaagtacaagcctgagtacgacggacttggactggatgtgtgtgaggtcacagtgccacgaccactgattgcgaaaggcggacagcagctctttagagtatctgcgacagcggattgggcggagaagaagacaacccatatattcagtcactgccgaggggaagaagacggctgaccacgcaacttgcactgtccgattctttgactgcgctgctgcggaggcggaatggaaacgagtttcctaccttgtcaagaggagcattgaccgactgcatgatatcgccgaaaatggtgacgctcaccgtcttggtagaggcatggtttacaaactcttcgctgccttggttgattatgacgacaacttcaagtccattcgcgaggttattcttgacagtgaacagcacgaagcgactgcacgcgtcaagttccaagcaccacaaggcaatttccaccgaaacccgttctggattgacagttttggacacctgtctgggttcatcatgaacgc

SEQ ID NO: 162 - DNA, 526 bp, Artificial Sequence
  Synthetic construct
attgctgatcccgagctcaaccgcgtcattcaaggccataaggtcaacggtactgctttgtgtccctcatcactatatgccgacatctctcaaacgcttgcagagtatctcatcaaaaagtacaagcctgagtacgacggacttggactggatgtgtgtgaggtcacagtgccacgaccactgattgcgaaaggcggacagcagctctttagagtatctgcgacagcggattgggcggagaagaagacaacccatatattcagtcactgccgaggggaagaagacggctgaccacgcaacttgcactgtccgattctttgactgcgctgctgcggaggcggaatggaaacgagtttcctaccttgtcaagaggagcattgaccgactgcatgatatcgccgaaaatggtgacgctcaccgtcttggtagaggcatggtttacaaactcttcgctgccttggttgattatgacgacaacttcaagtccattcgcgaggttattcttgacagtgaacagcacgaagcg

SEQ ID NO: 163 - DNA, 273 bp, Artificial Sequence
  Synthetic construct
gagtacgacggacttggactggatgtgtgtgaggtcacagtgccacgaccactgattgcgaaaggcggacagcagctctttagagtatctgcgacagcggattgggcggagaagaagacaacccatatattcagtcactgccgaggggaagaagacggctgaccacgcaacttgcactgtccgattctttgactgcgctgctgcggaggcggaatggaaacgagtttcctaccttgtcaagaggagcattgaccgactgcatgatatcgccga

SEQ ID NO: 164 - DNA, 117 bp, Artificial Sequence
  Synthetic construct
aggcggacagcagctctttagagtatctgcgacagcggattgggcggagaagaagacaacccatatattcagtcactgccgaggggaagaagacggctgaccacgcaacttgcactg

SEQ ID NO: 165 - DNA, 6927 bp, Artificial Sequence
  Synthetic construct
actaccctacacccacaaggactcgaaccaaggactgctcggtgggtgatacatatacacccagtatctatccagcttcaattttcggcgaattttgtttcttatttcataaagacactcgtttgatatctagctagatattgttgctcatcaacgaaatggttgtagattatcgaatatatccagcatcttttgatcgtagtcggaagtgaaatggagtactatgatacgacacatgtacattgtaagcagaaataggctagagggataactatcaaactgctgcagcagcgctactcttgcttctgtgcggggtcaaacttgtttgcgagccggactgccaaatcagggtctgggtaatgctgggggccgattccctgttatgcggtaaggattaactggggttctcaaaatgtttcacacagccacttcgttattccttatacctgccaaaatcccgcaatttaattccttagtacacccgttatacatctatcgctgataaggtttcatcataggtacaatagctttgattataggcacagtccaatgctaaatgcaatttcctaaacatgcgtgctttgatggataattatggaagtgtaattgtctgttcttttgcttttaatatgaaaccccgaggggacttggcgctggatttcataagtaataggggtagaggcgagcaaattgtgtccgaggactatgaaacccgagaaataaagcgggagagagggagactcagttgtcctttttgttcccctctggcattttgctttcctctagcttttccttcccctctgtcttttcgctctcctcgccatcttcgttctccgggaaaaaggggccttcgccctccacaatccttttaagagataccaaatgtttatcttcgtatatgagatccccagcatctttgaaaaccctcaagatgtcagagtttcgttccttcacatccatgagcattctggaaatggcctcgacggcgcactgcttgagacgtttctcaccagcgtcctttgccgcatcctgaatctcgtggagtcgcttgagccagtacatccatctccatggtgtgaacccagtcggtgaacaacgcttcccgaaatcagactcgatgaaacaggggccaccctggccaatcgtgctggggcaatcattccatgagacctctgagagttgcaaaaaattgtaccttgcctcgacgaaccatgcctggacagatggcaataagtgcataagctcgagggatcccatgctccggccaggatcttcattatcctgatcctcgctggtgcgaagctcttgtctctcctcaaatgcacagcggaagaggacaagggcgacctggcacattctgtccttgcagacgcgggttgacgctaactttgccaagaaagaggcaaagttcaggcgctgggtgcccgacattggtccgcagttgttgatccataagtcagtcatgtcggtaaccaagaacggcaggtcattccatagcgtgccttcggtcagtcgtgcgatatcgattccgtaatttcctttcacaggtctggttaacggtccctttccctggattcgtaggatatcgaggaccaggctatcgtgttctggagtttcatgcgacgtatgtaggctgagatggtagtacatataccatatctcacgaacgtagccttcgagggaatccaccccatccttaacattgcagtacctgtcggtgacgatccatgttcggctgaagaaggctgctccccgaacctccctaaattcaccccgagcgagactttgccgcacatcctgctgactatgggagacggtgtctgcctcgccgatgacggggaagccttttggcgaagggctcagcagggagtcacggaggcgatgcattttgaaatggtgatcgtgttcttcgatggatcagtcagagtatggtaataggtaggagagagggagtaagtcaaggaagtcacctgtgtgatgaacccaaccggggtttgaaccgcgaaaaggggcgttcagggggcgcctctgattctaatttttaggtcacgctctaggcagcaggatagtagttacaaggttctcacagccgacgaataatatgaccgtaaatggatccttttggatcctgtactccgcatgctagctgggcactggccgcggccgcgaattcgagctctgtacagtgaccggtgactctttctggcatgcggagagacggacggacgcagagagaagggctgagtaataagccactggccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgactaacagctaccccgcttgagcagacatcaccatgcctcaatcctgggaagaactggccgctgataagcgcgcccgcctcgcaaaaaccatccctgatgaatggaaagtccagacgctgcctgcggaagacagcgttattgatttcccaaagaaatcggggatcctttcagaggccgaactgaagatcacagaggcctccgctgcagatcttgtgtccaagctggcggccggagagttgacctcggtggaagttacgctagcattctgtaaacgggcagcaatcgcccagcagttagtagggtcccctctacctctcagggagatgtaacaacgccaccttatgggactatcaagctgacgctggcttctgtgcagacaaactgcgcccacgagttcttccctgacgccgctctcgcgcaggcaagggaactcgatgaatactacgcaaagcacaagagacccgttggtccactccatggcctccccatctctctcaaagaccagcttcgagtcaaggtacaccgttgcccctaagtcgttagatgtccctttttgtcagctaacatatgccaccagggctacgaaacatcaatgggctacatctcatggctaaacaagtacgacgaaggggactcggttctgacaaccatgctccgcaaagccggtgccgtcttctacgtcaagacctctgtcccgcagaccctgatggtctgcgagacagtcaacaacatcatcgggcgcaccgtcaacccacgcaacaagaactggtcgtgcggcggcagttctggtggtgagggtgcgatcgttgggattcgtggtggcgtcatcggtgtaggaacggatatcggtggctcgattcgagtgccggccgcgttcaacttcctgtacggtctaaggccgagtcatgggcggctgccgtatgcaaagatggcgaacagcatggagggtcaggagacggtgcacagcgttgtcgggccgattacgcactctgttgagggtgagtccttcgcctcttccttcttttcctgctctataccaggcctccactgtcctcctttcttgctttttatactatatacgagaccggcagtcactgatgaagtatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccatagctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggccgccgtaatggtcaagccgatttcgagaatgaccgtagtgttcattcatcagtgcgatattaaatcagttagctactctatctgaaagctaataaatttctttaccactaacaatactcttctctgactgaaagtaccttttccactcccctcatacttcatgttttaagctcaaccgtaggaaagcctgtatatcttaaaagatttggatttactcttccagcgcttactgtctgctctttcggccgagcgaaccttggcagtatgatcggactatgtactttgttacacaaaaggagaagcggggctgccactgaggacaacccctgttcaagggctagcatcccgctgtaagcccacccatcccaccttgaagtatgcaacttttgaccgcctagaccatgtgagcttatgttactgaaatactacccgcgaatcatttcctaatttgctttggctcgaatccaccccagccctacgtaacacaaccgggagctgccttacagcttggctgtatcacagtatcacatagatacatacatagtatagtgcctttgccttttcgacctataagcatccgccatatgctaaaccttctcatataccaacattttggatttggagatcatttcctagtgaaacaactttatcaaatgcatgcagccatcgtcctttgcagatccgagtggcccagtcaccgtgtcaacgtgtcagccgttttctctgctttttaggaaatgattaccactaggtaagcccaaaaatatcttcctggtaaacaagtagtgcatcttacccgaggctgaagcaggtaagggattttggagagaccccacccgtaagaatataccagccaagaggtccagtatcctgaagtatgtgaggcattaatgtcattggagaagtcatgcaatccataagctgccacccccaagatgactgcattggacctgagcattgtatgtgtcacctttcacacagagctcatgatctggtttataaaggcggcttcatgaccctcaattccatatagtatcactcccatcacagcatttcgatatcttcaaccactttaaccttctccagaggatcatcatctcaagcccttcataatgcaaatcaccacagttgccctttttctcttcgctgcaatgggcggggtagccacccccattgagtctgtatcaaacgacctcgatgccagggctgaggccggtgtcctggccaaatacaccggagtgagtaaacatcaatatcccataccttaagtactcacttgggaatcgcgactaacggttcgggaccacaactcagaaatgcaccaaatctaagaacgaatgtaaatacaagaacgatgctggaaaggacacttttatcaagtgccccaagtttgataacaagaaggtagaatatcaatcattcggaagtagccatctgaatcgatttcgtgctaatctcgctcttttttccagtgcaccaaggataataacaaatgtaccgtcgacacctacaacaacgctgtcgattgtgactagatggtctctgcgatcaccagggcatttaatggtttttggttcccttcttgttggtgatatgcgagatgccctgtgattctcg

SEQ ID NO: 166 - DNA, 33 bp, Artificial Sequence
  Synthetic construct
cttcgagaatcacagggcatctcgcatatcacc

SEQ ID NO: 167 - DNA, 32 bp, Artificial Sequence
  Synthetic construct
cttactaccctacacccacaaggactcgaacc

SEQ ID NO: 168 - DNA, 241 bp, Artificial Sequence
  Synthetic construct
ggggggtctcgaatggaccagctgatgagtccgtgaggacgaaacgagtaagctcgtcctggtcatgccgtaccgcaggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagaccgggg

SEQ ID NO: 169 - DNA, 19821 bp, Artificial Sequence
  Synthetic construct
cttgcccatcgaacgtacaagtactcctctgttctctccttcctttgctttgtgcttttccctcacatgttttgccgcaccagccatcccactatcaaaaagcgatgatgtttgagattgtcgggtgtccacatcttttagtgtgaatcgctagtagaatttgggatattattgagcatcatcccatgatagcgagtacaagccccgagtaaataccaacattgctatgctgctgtgctgctatctagtttgctacgttggtcgttgacctcacagggatttccaccaaaaagtggaccgggcgggcgccactcggccgtgccacagcagcctgagagcggacaaataacaacagccgcctgccgcggggttcggttgcaaacatgaccaacaggccaggccatcatcaacccaccgctgcgttgatgcccaggatttcagtccaataatccacaatttaccaacggatagagctaggtgaattagatagacaggagggccagagggaggggaccgagatgaaaaattttcgatgaaagagtggtcaaggtggggtcgtagttcggcgctccgagggcgaggaaccaaggaaaggcgaggaaaggacaggctgatcgcgctgcgttgctgggctgcaagcgtgtccagttgagtctggaaaaggctccgccgtgaagattctgcgttggtcccgcacctgcgcggtgggggcattacccctccatgtccaatgatttcaagtcaaagccaagggttgaagcccgcccgcttagtcgccttctcgcttgacccctccatataagtatttcccctcctccccctcccacaaatttttcctttccctttcctccctcgtccgcttcagtacgtatatcttccccccctctctcttccttctcactcttctctccttctttcttgattcatcctctctctaactgacttctttgctcagcacctctacgcgttctggccgtagtatctgagcaatttttctacagactttttctatctaattccaaaaaagaacttcgagttcattcaccaccgtcaaaatggaccagctgatgagtccgtgaggacgaaacgagtaagctcgtcctggtcatgccgtaccgcaggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgtgctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagcaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 170 - DNA, 998 bp, Artificial Sequence
  Synthetic construct
aggagccttgcgctgacatagtctgtgtggaatttatcaggtggctccatccgtgtaccctctgcattcaactttctgtatggtatccgaccaagtcacggcaggatgccgtacgcaaagatggccaacagcatggcgggccaggaatccgtccagagtgtgacgggaccgattgcccattccgttccaggtgaggatctgccattgattttgctctgcaagaggtggcagctaatactgatcaattgtctgttagacctgagattgttcctcactgcagtcttggcccaggagccatggaagtacgactccaaagtcatccctctgccatggagacagagcgaagaggatgttatcaagaacaaaatcaagtctggtggtcttactctcgggttctacaattgtgacggaatggtgagttattacctgtgcagaaggattatttgagatgactgacacgtatatgaaatttccaggtgcttcctcacccgccaattaatcgcggtatcgagacagttgtgtcgacattgaggaagaacggccacgacgtcgtcgaatggactccttacaatcatgaattggcgttgaaaatcctctattgtttctttacctctgacggcggcgccgacgtccgtcgcgacatggacgcctctggcgagccccccgtccccaatatcaacgacctgctcggctactcgaacagggccttcgacatcaacgagctgtgggacgtcaacctccagaaatggcgctaccagtgcgagtatctcgacaagtggcgcgagcttgaagagaagctgggaaaagagctcgatgctatcatcgccccgataaccgccacggccgcaatccgccacgaccagttccggtactacggatattcagccgcgatcaacacgctcgactttacgagtgtagtggtgcccgtcacgtttgccgataagacggtcgatgtgaagaaggaagactaccagcctctgaacgatatggataaagca

SEQ ID NO: 171 - DNA, 1247 bp, Artificial Sequence
  Synthetic construct
taatgggcagatcccaagtcctcaatcaggaaactctctctttctctgcgtggccctgctggagaacctccccaattgcaggccactgacaccaggtccgtttatcagctccctccggccccaaaatgaaaactatctgcgacctatttattgcctatttcaatttgtcacgcctggaccggtggggttggtcttggaaggattctgtaccctgaaaggctaatgggggaaacacccgattagaagaagaaactaatgcgagagacgcaaacgagatagatatatagttacatcgcctgctgccactagatttcacggagacgactccttccctgccttgaaactcgtccaatcctggattgttgcaagttcatccagttagggataaaggtgtcaacaccattggagagatcagagttacagttagtactatttcttcgctgatcgctgctactatacacctcttatctacagtatatatataattctgatacaacaaactctgactttttaaaactgtgtactggcgaccaatcgacaaatctgcaaccccagcttcataagctttctctcccaccagcaaagcctggacctccctggttctaataatgagcgactgaagttttccaaaagaaaccttcactaaacatgttatgctcctcaatcacgcgatgaaataaaggcctattttttgatccaacgcctttgaaaatttccttatggctgggtggggtacctaccatgaacactttgaaatgagatgtatgtcgagctatgaaatggatgctccatcttgtacagctgtgcggagctcatatatctgacgatgttagatccatgattcattcatatactacagaatactagatgtgtactgtactccgtataacgtattattttccggactctcgaaccttttccagtccatcgtactatatatcccacttaggatattatctgactagaggataaaccacggaaatccattccccgtaagaccaaggcattatctggaactgatgtaatcagcctcgcgccttatctcgacatggccgagctaattccctggtccggcggggcagtcgaatcagacggaccgaacaactcacaggccgcaggccgattggctgcgtctgccgggctgatgtatataaagcttcgaggataatccttgctgtcaatccatgttgaattctgaaatgagtagctctgtgcttgtcaactaagttagaggagtatacggtgca

SEQ ID NO: 172 - DNA, 4517 bp, Artificial Sequence
  Synthetic construct
aggagccttgcgctgacatagtctgtgtggaatttatcaggtggctccatccgtgtaccctctgcattcaactttctgtatggtatccgaccaagtcacggcaggatgccgtacgcaaagatggccaacagcatggcgggccaggaatccgtccagagtgtgacgggaccgattgcccattccgttccaggtgaggatctgccattgattttgctctgcaagaggtggcagctaatactgatcaattgtctgttagacctgagattgttcctcactgcagtcttggcccaggagccatggaagtacgactccaaagtcatccctctgccatggagacagagcgaagaggatgttatcaagaacaaaatcaagtctggtggtcttactctcgggttctacaattgtgacggaatggtgagttattacctgtgcagaaggattatttgagatgactgacacgtatatgaaatttccaggtgcttcctcacccgccaattaatcgcggtatcgagacagttgtgtcgacattgaggaagaacggccacgacgtcgtcgaatggactccttacaatcatgaattggcgttgaaaatcctctattgtttctttacctctgacggcggcgccgacgtccgtcgcgacatggacgcctctggcgagccccccgtccccaatatcaacgacctgctcggctactcgaacagggccttcgacatcaacgagctgtgggacgtcaacctccagaaatggcgctaccagtgcgagtatctcgacaagtggcgcgagcttgaagagaagctgggaaaagagctcgatgctatcatcgccccgataaccgccacggccgcaatccgccacgaccagttccggtactacggatattcagccgcgatcaacacgctcgactttacgagtgtagtggtgcccgtcacgtttgccgataagacggtcgatgtgaagaaggaagactaccagcctctgaacgatatggataaagcaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgccctt

SEQ ID NO: 173 - DNA, 4766 bp, Artificial Sequence
  Synthetic construct
taatgggcagatcccaagtcctcaatcaggaaactctctctttctctgcgtggccctgctggagaacctccccaattgcaggccactgacaccaggtccgtttatcagctccctccggccccaaaatgaaaactatctgcgacctatttattgcctatttcaatttgtcacgcctggaccggtggggttggtcttggaaggattctgtaccctgaaaggctaatgggggaaacacccgattagaagaagaaactaatgcgagagacgcaaacgagatagatatatagttacatcgcctgctgccactagatttcacggagacgactccttccctgccttgaaactcgtccaatcctggattgttgcaagttcatccagttagggataaaggtgtcaacaccattggagagatcagagttacagttagtactatttcttcgctgatcgctgctactatacacctcttatctacagtatatatataattctgatacaacaaactctgactttttaaaactgtgtactggcgaccaatcgacaaatctgcaaccccagcttcataagctttctctcccaccagcaaagcctggacctccctggttctaataatgagcgactgaagttttccaaaagaaaccttcactaaacatgttatgctcctcaatcacgcgatgaaataaaggcctattttttgatccaacgcctttgaaaatttccttatggctgggtggggtacctaccatgaacactttgaaatgagatgtatgtcgagctatgaaatggatgctccatcttgtacagctgtgcggagctcatatatctgacgatgttagatccatgattcattcatatactacagaatactagatgtgtactgtactccgtataacgtattattttccggactctcgaaccttttccagtccatcgtactatatatcccacttaggatattatctgactagaggataaaccacggaaatccattccccgtaagaccaaggcattatctggaactgatgtaatcagcctcgcgccttatctcgacatggccgagctaattccctggtccggcggggcagtcgaatcagacggaccgaacaactcacaggccgcaggccgattggctgcgtctgccgggctgatgtatataaagcttcgaggataatccttgctgtcaatccatgttgaattctgaaatgagtagctctgtgcttgtcaactaagttagaggagtatacggtgcaaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgccctt

SEQ ID NO: 174 - DNA, 1198 bp, Artificial Sequence
  Synthetic construct
ggtctcccattttgacggtgggaactttttgtagttctttgtaagatactagaaaaaatctgtaggaaaatttgctcagagactacggcaaaacgcgtagaggtactgagcaaaagtaatcagtaaaagttgtcgaaagatgaagagctgaaaagcagtaggggggcaggaaaaactcactgtagcagacaagaggaagaaagaaaagtctgtgggagaagggaggaggggaaatccttatatggaggggcaagcgagcgaggcgagtcagcaggtggggtcaagccctcttttggttagggcttctgattggctctgcccttcacccttgtacgcagattttgcaaagtgggttggtgggatgaagtagatgtacttgctacactatgtgtttattcatactttgtaatgtactattacctctgcgcttgaaacacccatccgtttccctggttgtgtcctgccatggcactccactcggtgcgaaatttttttttttcatcggctcccagtccactttgtggctctaaacgcttgaactgggcagcaacgcagagcggttgggtgagaatcttcaagtttgcattgtttactttgcccattttcccgttttcttttggccctatacgaatttactgtgttactgtggcgatactggatgtctcgatccatttttttacttttttctctctctttttttttctttttgagaaccccgcggatgaggggcaacactctcaccgccaacttatcccaccaacaatgtcatgtatagaaaattctttctttttggcctccaatgatcagattcttctttagtatttcccaggcagaaaccaatgtcgggctctacatttgtactagggcaattgtagtcatagcgaaaaaaaaaagtacaaagccaaagatacacaataacatgtgatataaaattcaaaatgcataaaaagctagatccatccatggatgtccgctgatcgcaaaataatctgtgcgctggactgtgacgtcgatcaatttgggtatcaggtttaagttactccgtacacacgcctcccctatgttgtaaacacttgataaatacgccacttgcacctcgctatagtaaaacaaaaaaagcaaaagcaaaagcaaaatgaaaccaaaaagcaatgcaagtgacttgcccccggccttgccgcccaactgcaccgagacc

SEQ ID NO: 175 - DNA, 241 bp, Artificial Sequence
  Synthetic construct
ggggggtctcgaatggtgaggctgatgagtccgtgaggacgaaacgagtaagctcgtccctcacccgccaatccttcggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagaccgggg

SEQ ID NO: 176 - DNA, 19968 bp, Artificial Sequence
  Synthetic construct
cttgcccatcgaacgtacaagtactcctctgttctctccttcctttgctttgtgcagttgggcggcaaggccgggggcaagtcacttgcattgctttttggtttcattttgcttttgcttttgctttttttgttttactatagcgaggtgcaagtggcgtatttatcaagtgtttacaacataggggaggcgtgtgtacggagtaacttaaacctgatacccaaattgatcgacgtcacagtccagcgcacagattattttgcgatcagcggacatccatggatggatctagctttttatgcattttgaattttatatcacatgttattgtgtatctttggctttgtacttttttttttcgctatgactacaattgccctagtacaaatgtagagcccgacattggtttctgcctgggaaatactaaagaagaatctgatcattggaggccaaaaagaaagaattttctatacatgacattgttggtgggataagttggcggtgagagtgttgcccctcatccgcggggttctcaaaaagaaaaaaaaagagagagaaaaaagtaaaaaaatggatcgagacatccagtatcgccacagtaacacagtaaattcgtatagggccaaaagaaaacgggaaaatgggcaaagtaaacaatgcaaacttgaagattctcacccaaccgctctgcgttgctgcccagttcaagcgtttagagccacaaagtggactgggagccgatgaaaaaaaaaaatttcgcaccgagtggagtgccatggcaggacacaaccagggaaacggatgggtgtttcaagcgcagaggtaatagtacattacaaagtatgaataaacacatagtgtagcaagtacatctacttcatcccaccaacccactttgcaaaatctgcgtacaagggtgaagggcagagccaatcagaagccctaaccaaaagagggcttgaccccacctgctgactcgcctcgctcgcttgcccctccatataaggatttcccctcctcccttctcccacagacttttctttcttcctcttgtctgctacagtgagtttttcctgcccccctactgcttttcagctcttcatctttcgacaacttttactgattacttttgctcagtacctctacgcgttttgccgtagtctctgagcaaattttcctacagattttttctagtatcttacaaagaactacaaaaagttcccaccgtcaaaatggtgaggctgatgagtccgtgaggacgaaacgagtaagctcgtccctcacccgccaatccttcggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgagctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcaactctctggaaatgaaggcagccccgaagttttgggatactagcgatcctaggcactgcaccagtcttgaagagggtcatctctccggagattagtccatctgtggcattgtttatactttcacacctccagaacaacatggaagtcaaggaatgtggtatcagactcacaaccaagagatttctcaccaaagcgctagttccaaggcaggtctagcgtgctgacgatggggataatttagccggctaattggtggacatccgccaccaccccagattaaacggtggagatgacagggggcggagattcaacgggattaaatatcggagatgaagactcggcatctgcttgaggcagttagtgcttgatgcaacttgtggtcggtcgaagcgattggcatggtgatcaacgatcggataataagacctcccatgtgcctcgggggatattcgatccgcctgctgaagagagtaatgatggacctgatacttgcagaatctgaactgaagcccttgactagcgctggaactaaatttcaagctaacggtgatgcagcagaaggatgacgatcttttcctaacggatttctccgcagacccccgagcgcattctgcaataccatgcacctttcatgcacctttcatgcaagttccatgcaactcccacacatgtgcattaatatgccttagctctctcgaatgaactttcacgtggcttaagtcccctcacctgcacccatataaaagccaagttcttcccccacgatgacaccaaccccaactcaccttccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 177 - DNA, 8417 bp, Artificial Sequence; identical to SEQ ID NO: 107
  Synthetic construct

SEQ ID NO: 178 - DNA, 55 bp, Artificial Sequence
  Synthetic construct
ccctcactaaagggaacaaaagctgggtacgcttgcaccaatcgccgtttaggtg

SEQ ID NO: 179 - DNA, 19242 bp, Artificial Sequence; identical to SEQ ID NO: 110
  Synthetic construct

SEQ ID NO: 180 - DNA, 20288 bp, Artificial Sequence
  Synthetic construct
cttgcccatcgaacgtacaagtactcctctgttctctccttcctttgctttgtgcagttgggcggcaaggccgggggcaagtcacttgcattgctttttggtttcattttgcttttgcttttgctttttttgttttactatagcgaggtgcaagtggcgtatttatcaagtgtttacaacataggggaggcgtgtgtacggagtaacttaaacctgatacccaaattgatcgacgtcacagtccagcgcacagattattttgcgatcagcggacatccatggatggatctagctttttatgcattttgaattttatatcacatgttattgtgtatctttggctttgtacttttttttttcgctatgactacaattgccctagtacaaatgtagagcccgacattggtttctgcctgggaaatactaaagaagaatctgatcattggaggccaaaaagaaagaattttctatacatgacattgttggtgggataagttggcggtgagagtgttgcccctcatccgcggggttctcaaaaagaaaaaaaaagagagagaaaaaagtaaaaaaatggatcgagacatccagtatcgccacagtaacacagtaaattcgtatagggccaaaagaaaacgggaaaatgggcaaagtaaacaatgcaaacttgaagattctcacccaaccgctctgcgttgctgcccagttcaagcgtttagagccacaaagtggactgggagccgatgaaaaaaaaaaatttcgcaccgagtggagtgccatggcaggacacaaccagggaaacggatgggtgtttcaagcgcagaggtaatagtacattacaaagtatgaataaacacatagtgtagcaagtacatctacttcatcccaccaacccactttgcaaaatctgcgtacaagggtgaagggcagagccaatcagaagccctaaccaaaagagggcttgaccccacctgctgactcgcctcgctcgcttgcccctccatataaggatttcccctcctcccttctcccacagacttttctttcttcctcttgtctgctacagtgagtttttcctgcccccctactgcttttcagctcttcatctttcgacaacttttactgattacttttgctcagtacctctacgcgttttgccgtagtctctgagcaaattttcctacagattttttctagtatcttacaaagaactacaaaaagttcccaccgtcaaaatggtgaggctgatgagtccgtgaggacgaaacgagtaagctcgtccctcacccgccaatccttcggttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaatgcgctaaactgggcttgactcagggagggatcatggactagccaattgggcgtgcacagcgcgactttggagctggttctggctcgcatgacttgtttcgtgctgcgggggattccgttcggacctgacattttaaaaataaaaaatggaaacatcttgaaagacaaaaatgagtttcagtagtggtctacagaccgtagttttgttcctattcacagtgaaaataaggcgctgcaattgctacgttcataaatcgagtattgttgagctccgaagcgccagtccccatgttccgcaccctccggatcgatgtacacaaccgactgcacccaaacgaacacaaatcttagcagtgccctcgccggatagcttggactgtcctttaccgtcgccagcacaagaagggtatctctgaggtccgtaccgccttttctttaccactggattcgattttcgcagttggaatgatacatctggggactgcgaatggtttacccctcggccgatactatgggtcgtgaagagatggaacattccgaaagtgttttgcggataacattggtggcatcgaaaacagaatgctgaccattgatttcaacacgaacaggaggttgccaagaagcgtacccgccgtgtcgtcaagtcccagcgtgccatcgtcggtgcttccctcgacgtgatcaaggagcgccgctcccagcgccccgaggcccgtgccgccgcccgccagcaggccatcaaggacgccaaggagaagaaggctgccgctgagtccaagaagaaggctgagaaggctaagaacgccgctgctggtgccaagggtgctgctcagcgcatccagagcaagcagggtgctaagggttctgctcccaaggtcgctgccaagtctcgttaaggaatgaataacggttcggcttgggattgggtgcggaaggcaagagtttcatggacgaattttgggaggttactggagctggaatatgtgttttccctaccaccaaaaatgaaatgttccaaaactatcggcgtgcaagacggcctcttacgggtttaacggctctcagataagctctatcaatcgcgccacggatgcatgaatgaagatccagatggccgcgggatatatcgtgctagtgtaattcctacatgatcttgctgttcactccatgcgcatccagatattccaggggtcgactgttaattgatatgcctgggcttgagactccgtagacgcccagtcaatgtgcaattaatacgagggtgctgttatcggcagcaaccttgtacttctccataagatgggggaatgccatggacctgagtgatcaattgacgcaagtctcccataacgcggcggcttgacctaaaatccatataccgccccgttgagcctccgcgctccagagtcctgtcccggaatagggcacaaacctaggctaacctaattcgtcgtccgcgtctgagttcagacaaaagaacttccaagtatcagcagagtacgctgatattgataagtaggcaaacataagaccaataagcaagtagaataaaaaattataaggacactgcctccataaagcgccctcccaagacctcagggacaaaacttctcaagtggcaattcactgcctcaggccgtgtccagtgaagtgacgaagcgacactgttgcctgctgactcagccgctttccgccctgccgaatttgccatctcgcttacaggtcagcactagcgcgattcgcccacagatgctcagcgcaaagtggtgactcagtcaaaccccccctacaagattccacctcgatttttcaacttcccatctcgatccgacaagttctacatccaccgtcaaaatggcctccagcgaagatgtcatcaaggagttcatgcgcttcaaggtccgcatggaaggatccgtcaacggccacgagttcgagattgagggtgagggtgagggccgcccctacgaaggcacccagactgccaagctcaaggtcaccaagggtggtcctctccccttcgcttgggatatcctgtctcctcagttccagtacggctccaaggtctacgtcaagcaccccgccgacatccccgactacaagaagctttctttccccgagggtttcaagtgggagcgtgtcatgaacttcgaggatggtggtgttgtgaccgttactcaggacagcagcttgcaggatggctctttcatctacaaggtcaagttcattggtgtcaacttcccctccgacggccctgtcatgcagaagaagaccatgggctgggaagcgtcgactgagcgtctgtacccccgtgacggtgttctcaagggtgagatccacaaggctctcaagctcaaggacggtggtcactaccttgttgagttcaagtccatctacatggccaagaagcctgtgcagctgcccggatactactacgtggactccaagcttgacatcacctcccacaacgaagactacaccattgttgagcagtacgagcgtgctgagggccgccaccacctcttcctgacccacggaatggatgagctgtacaagtcgaaactataaataaatggtttgcgttgcgattgactgaaacgaaaaaaagcgaaaatgattctgggaatgaattgataaagcgcgggctctgcggtacggttacggttgcggtcgcggacgaatggactgggctgagctgggctggaggaagtccatcgaacaaggacaaggggtggaatatggcacgggtcgattttgttatacataccctaccatccatctatccatttaaataccaaatgagttgttgaatggattcgcggtcttctcggtttatttttgcttgcttgcgtgcttaagggatagtgtgcctcacgctttccggcatcttccagaccacagtatatccatccgcctcctgttgaagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttgtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaagcctgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggacaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctcccgggtttagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccattttgacggtgggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgctcccggctcgtatgttgtgtggaattgtgagcggataacaatttcacacaggaaacagctatgaccatgattacgccaagcgcgcaattaaccctcactaaagggaacaaaagctgggtacgcttgcaccaatcgccgtttaggtgttcattaggttgtattttggctatttattgcgatatttaagcgaggcgaacatgggataaaacgtttgctgttagtgtttgtgtatatgctagcgacttagagtgcacgctcaaaagatacccctaacttctgatttgatagcatttgtatatggcatatagtacgcctgaagcataaaaaaaaaaacagaattattatagtttattaatacgagacagcagaatcaccgcccaagttaagcctttgtgctgatcatgctctcgaacgggccaagttcgggaaaagcaaaggagcgtttagtgaggggcaatttgactcacctcccaggcaacagatgaggggggcaaaaagaaagaaattttcgtgagtcaatatggattccgagcatcattttcttgcggtctatcttgctacgtatgttgatcttgacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacaccaccgtcaaaatggacaagaagtatagcatcggtctggacattggcaccaactccgttggctgggctgtcatcaccgacgagtacaaggttcctagcaagaaattcaaggtcctgggaaacaccgatcgtcactccatcaagaagaacctcattggtgcgcttctcttcgactccggtgagactgctgaggccacccgtctgaagcgtaccgctcgccgtcgttacactcgccgcaagaaccgtatctgctacctccaggagattttctccaacgagatggccaaggttgatgactctttcttccaccgtctggaggagtcgttccttgttgaagaagacaagaagcacgagcgtcaccctatcttcggtaacattgtcgatgaggtcgcttaccacgagaagtaccccaccatctaccacctacgcaaaaagctcgtcgacagcaccgacaaggctgacctccgcctcatttacctggctctggcgcacatgatcaagttccgtggtcacttcctgatcgagggtgacctcaaccccgacaactccgatgttgataaactcttcatccagctcgttcagacctacaaccagcttttcgaggaaaaccccatcaacgcgtctggcgtggatgccaaggccatcctctccgctcgcctgagcaagtcccgccgtcttgagaacttgattgcccagctccctggtgagaagaagaacggtcttttcggcaaccttattgccctgtccctcggactgactcccaacttcaagagcaacttcgatcttgctgaggatgctaagttacaactttccaaggatacctacgacgacgaccttgataaccttctcgcccagataggagatcagtacgccgacctcttcctagctgccaagaacctctccgatgccattctcctgtcagatatcctccgtgtcaacactgagatcaccaaggcccctctctccgcctctatgatcaagagatacgatgagcaccaccaggacctcaccctactcaaggctctggtccgccagcagctccccgaaaagtacaaggagatcttcttcgaccagtccaagaacggctacgccggttacatcgacggtggtgcttcccaggaagaattctacaagttcattaagcctatcctcgagaagatggatggcactgaggagcttcttgttaagctgaaccgtgaggaccttctgcgcaagcagcgtactttcgacaacggcagcatcccccaccagatccacctgggtgaattgcacgccatccttcgtcgccaggaagacttctaccctttcttgaaggacaaccgtgagaagattgagaagatcctgaccttccgtatcccctactacgtcggtcctctggctcgcggtaactcccgcttcgcctggatgacccgcaagtccgaggaaaccatcaccccctggaacttcgaggaagtcgtcgacaagggtgcctccgctcagagcttcattgagcgtatgaccaacttcgacaagaacctgcccaacgagaaagtcctgcccaagcactccctcttgtacgagtacttcactgtctacaacgagctgaccaaggtcaagtacgtgaccgagggcatgcgcaagcctgctttcctctccggcgaacagaagaaggccattgtcgacctgctgttcaagactaaccgcaaggtgaccgtcaagcagctcaaggaagactacttcaagaagatcgagtgctttgactccgttgagatctccggtgttgaggaccgcttcaacgcttctctcggcacctaccacgatctgctcaagatcatcaaggacaaggacttccttgacaacgaggagaacgaagacattcttgaggacattgttcttaccctcaccctcttcgaggaccgtgagatgatcgaagaacgtctgaagacctacgctcacctcttcgacgacaaggtcatgaagcagttgaagcgccgccgttacactggctggggtcgcctctctcgcaagttgattaacggtatccgtgataagcagtctggcaagaccatccttgacttcctgaagtccgacggcttcgccaaccgcaacttcatgcagctcatccacgacgactctctgaccttcaaagaggacatccagaaggcccaagtctccggccagggtgactcgctacacgaacacattgccaacctggctggttcccccgctatcaagaagggtatcctgcagactgtgaaggttgttgacgagcttgtgaaggtcatgggtcgtcacaagcccgagaacatcgtcatcgaaatggctcgtgagaaccagaccactcagaagggtcagaagaacagccgtgagcgcatgaagcgtatcgaggaaggcatcaaggagctcggttcccagattctcaaggaacaccccgtcgagaacacccagctgcagaatgagaagctctacctctactacttgcagaacggacgtgacatgtacgtcgaccaggagctggatatcaaccgcctctccgactacgatgttgaccacatcgtcccccagtccttcctcaaggatgacagcattgacaacaaggtgctcacccgttccgacaagaatcgtggcaagagcgataacgtcccctcggaagaggttgttaagaagatgaagaactactggagacaattgctcaacgctaagctcatcactcagcgcaagttcgacaaccttaccaaggccgagcgtggcggactctccgagctcgacaaggccggtttcatcaagcgtcaattggttgaaacccgtcagatcactaagcacgttgcccagatcctggactctcgcatgaacaccaagtacgacgagaacgacaagctcatccgtgaggtcaaggtcatcaccttaaagagcaagctggtcagtgactttaggaaagacttccagttctacaaggtccgcgagatcaacaactaccaccacgctcacgatgcctacctcaacgccgtcgtcggtactgctttgattaagaagtatcccaagctcgagtccgagttcgtctacggtgactacaaggtgtacgacgtgcgcaagatgatcgctaagtccgagcaggagatcggaaaggccactgccaagtacttcttctacagcaacatcatgaacttcttcaagaccgaaataacattggccaacggcgagattcgcaagcgtcccttgattgagactaacggcgaaaccggtgagatcgtctgggacaagggccgtgacttcgctaccgtccgcaaggtcctttctatgccccaggtcaacattgtcaagaagaccgaggtgcagactggtggtttctccaaggagtcgattcttcccaagcgcaactccgacaagctgatcgctcgcaagaaggattgggaccccaagaagtacggtggattcgattcgcctaccgttgcctactccgtcttggttgtcgccaaggtcgagaagggcaagagcaagaagctgaagagtgtgaaggaactcctcggtatcaccatcatggaacgcagcagcttcgagaagaaccctatcgacttcctggaggccaagggttacaaagaggtcaagaaggacctcatcatcaagctccccaagtactctctgttcgagctggagaacggccgtaagcgcatgcttgcttccgccggtgagctccagaagggtaacgagcttgccctcccctccaagtacgtcaacttcctctacctggcctcccactacgagaagctcaagggctctcccgaggacaacgagcagaagcagctctttgtcgagcagcacaagcactacctggatgagatcatcgagcagatctccgagttcagcaagcgtgtcatcctggccgatgccaaccttgacaaggtcctctctgcctacaacaagcaccgtgacaagcccatccgcgagcaggcggagaacatcatccacctgttcaccctcaccaacctgggtgctcctgctgctttcaagtactttgacaccaccatcgaccgcaagcgttacacctccaccaaggaagtgcttgatgcgactctgatccaccagtcgattaccggtctgtacgagactcgtatcgacctgtctcagctcggtggtgactctcgtgccgatcccaagaagaagcgcaaggtttaaacaagcgcttagctcgaacaaaagaaaaagtaaaaacggttaatagcattggattccgaactacaaagtataaactagtttcactccttgtagaagccagatacgggccggggtagataccgcgcactccctcagcagcctcgcagtcatggtcagcatcgaagaactcccacacaaaatgcgctgggagaagagttcgaaatgcagctgggctcaattagccgtcgtacacggagatagatactgaatacatacccgtttgagcctgaaaatttttgacattcgtgcccataccatgaacctcgtac

SEQ ID NO: 181 - DNA, 19 bp, Artificial Sequence
  Synthetic construct
gagccttgcgctgacatag

SEQ ID NO: 182 - DNA, 23 bp, Artificial Sequence
  Synthetic construct
ccatatcgttcagaggctggtag

SEQ ID NO: 183 - DNA, 24 bp, Artificial Sequence
  Synthetic construct
ggcagatcccaagtcctcaatcag

SEQ ID NO: 184 - DNA, 20 bp, Artificial Sequence
  Synthetic construct
gcaccgtatactcctctaac

SEQ ID NO: 185 - DNA, 20 bp, Artificial Sequence
  Synthetic construct
caggtgaggatctgccattg

SEQ ID NO: 186 - DNA, 19 bp, Artificial Sequence
  Synthetic construct
gagccttgcgctgacatag

SEQ ID NO: 187 - DNA, 23 bp, Artificial Sequence
  Synthetic construct
ccatatcgttcagaggctggtag

SEQ ID NO: 188 - DNA, 24 bp, Artificial Sequence
  Synthetic construct
ggcagatcccaagtcctcaatcag

SEQ ID NO: 189 - DNA, 20 bp, Artificial Sequence
  Synthetic construct
gcaccgtatactcctctaac

SEQ ID NO: 190 - DNA, 8816 bp, Artificial Sequence
  Synthetic construct
caggaaacagctatgaccatgattacgccaagctatcaactttgtatagaaaagttggctgtcattgagtcgctaggttatctcctcttatgtctgccaaagacaagaaaggtcggactatcattcttggttgggtttgatacatgacttttgtgttcggtcgttgttcttgtgctaaataaagccttgtgcttccttttatctggtcatacgtagaaacagcggccatgatagctaggaaaccactcaatctgttttatttattttattttctttttcataaaatatggtctgtttgcggtcatttatggcgggagctcggcccgctcgatcgatggcttgagaacatctgggtcgccatgggcgatcgatcgatgacccacgtgcataagtgacagcgcattccagattaccaattaagggactgatatcgaagatatcggacagttttatttgaagatcttatttatggcccagatgtcaccgtaaaatgatagtggaatcttccatcctgctgcgaccatctaaaacacgactcgatgtctcagaaaaatgtctcgaagctgaagtcatgacatgacgtatgcaaaacattacaatgatacctttagatctacatttcctcaccccattagtaagatatctgcagatactgttgataatcggtttctatactcgaatcgtggattcacatccctcgacgattttatgctgtctgacggggttattccatacttagcatgctgttgctatggcttctgaaatttaagagaaagaatcccctttaaggcgttctaatgcacattgatgcattgaaatttcttgtctaaagaactgggaggttggtttacgtagggcaaacaaagtcacgtgtcacatagcaacagtgctgtaaccttccgaatgcagcgacatcatttctttcattgcaacttcatcgtaatttttcttcggaacaggtctcttgtctatgatcccactatctcatgacaggctctccacggatagctcggctcactgcccatcttaatacttgatttctgcagtcattgcttgttttatccgcaaacagcacacacgcatcctggaactatcatcggtttgccggcagctttagtaactcggacccataatctagggtccaatcgggttatccaaggaaccaagcttttagttcggtccagcccatctccacttaggctctgtaaggcagacatactgaactctgggagtcatggaatctactgcagtaacggtaccattgttcagttttggggtacacatcagtacgagaaatacgagatctatagacttcactgattactggagaataagtcgcgggaacatacattcccaaaggtttcagctgggttaccataccatataaccctgattcccaagaaaaagaacctggaactaaaactcttccatttcctgcttagatacttctaagaaaattggaaggaagtcattaacttgctaccgacccacttcagggaaaatactcccgtcacatcctttataaagtaagatatccgtcaatttgcgccgggcgtaaactttccttctttctccatatacgcctgaaaccaataattcgccactggcaagtttgtacaaaaaagcaggctcgcaggaattcgagctctgtacagtgaccggtgactctttctggcatgcggagagacggacggacgcagagagaagggctgagtaataagccactggccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgactaacagctaccccgcttgagcagacatcaccatgcctcaatcctgggaagaactggccgctgataagcgcgcccgcctcgcaaaaaccatccctgatgaatggaaagtccagacgctgcctgcggaagacagcgttattgatttcccaaagaaatcggggatcctttcagaggccgaactgaagatcacagaggcctccgctgcagatcttgtgtccaagctggcggccggagagttgacctcggtggaagttacgctagcattctgtaaacgggcagcaatcgcccagcagttagtagggtcccctctacctctcagggagatgtaacaacgccaccttatgggactatcaagctgacgctggcttctgtgcagacaaactgcgcccacgagttcttccctgacgccgctctcgcgcaggcaagggaactcgatgaatactacgcaaagcacaagagacccgttggtccactccatggcctccccatctctctcaaagaccagcttcgagtcaaggtacaccgttgcccctaagtcgttagatgtccctttttgtcagctaacatatgccaccagggctacgaaacatcaatgggctacatctcatggctaaacaagtacgacgaaggggactcggttctgacaaccatgctccgcaaagccggtgccgtcttctacgtcaagacctctgtcccgcagaccctgatggtctgcgagacagtcaacaacatcatcgggcgcaccgtcaacccacgcaacaagaactggtcgtgcggcggcagttctggtggtgagggtgcgatcgttgggattcgtggtggcgtcatcggtgtaggaacggatatcggtggctcgattcgagtgccggccgcgttcaacttcctgtacggtctaaggccgagtcatgggcggctgccgtatgcaaagatggcgaacagcatggagggtcaggagacggtgcacagcgttgtcgggccgattacgcactctgttgagggtgagtccttcgcctcttccttcttttcctgctctataccaggcctccactgtcctcctttcttgctttttatactatatacgagaccggcagtcactgatgaagtatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccatagctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcgagacccagctttcttgtacaaagtgggtgcctacttccaggacatttgtatatgggtccttttctctttgtttgtccattttgtatgctgctgtccgggttctttctttcctccctgtctttgtatcttagtctatacataatcccataattctgcggtttgctactcttgggttacattttaattaccgaatatgaataccagattgatattttacatttggaagcgttgtttttattttaaaaggtataaaatgaatggctagagtaaatccaacactgaaggggaacaggtgcagcctagaaatcgaacgaaccaagatgtctgtcattggagctatgatgaaaagaattgctatgaaaaacgaatggaacagcagcacttggagagaacacaagactcagataccgttgcatccgagacccgctttattcttgcgaaacgaaaatcgctcatgggtaaatgggaaagtcgcaatggatgaaggatgaaacgccaggaagatgcaatgtcgtaacgagcggatgaaaggaataaagatctggctaaggtgattgtgaaatgcttcgcaaagagcaaataccccgtctatgtatcgtgtctagacatcatagattggccggggcgagggaaaacacacgccaagaacatgaggcgtgggaaacccggagaaatcgagtgatgtcttagaaaggcatctctgagctgtatcgtaacgcactgcccctacccccaatcccgccattaccgttgccattattaccaacccccgggctggtcggacggctgccggcccacttggggcttcgtggttgagtgctagttgagcgagtcgatggacgattcttccggatttcacgaagctcatcttcctttctgcgtaggaattcgtcgcgcgtggccagaattaattctagctcttcgattcgagctatatgacgaactgactcgtccttcatgtgtaactcactaagtcggacggcattgctctcagccttgcgctttagtctctcattctcggcggccaaatggcggctttctgtgccagactgagcggccgctgtagacgcagtttgatattgctctcgcatgtactcggattggtttttctcgaactcagccttgcgctcaaggtttgaattttctttggccagacggcggatttcctcgcgtgctgtctccagttcagcaggactgccacctccatctttgagtgctagtctggcttcgtcgagctcccgcttcagctctgcccgttcttctttcaagctagagatagtctccttttgtttctcgatgcgttgttccagagacggcttattttctgacaggcgatcacgctcttggcgaattgcgtggagttcattcatccggctctcgtaacggtgttgtagaatacccagagccttctctatttcttcgaatcgagagtttgcccgagcaagctcagcctgcaactgggctttttcacttccgtggatgtgtttcatctgaataagatttttctctagtgactgcaaatcacggtccaatgtctgactgggaggcttagttgactcggtcagctggctgtcctcttgggtaccgacccgtgcgcgtttcgatgagggttcctcgggttcctcgtcctgccacaaatgttagttgaatccaactttattatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcaca

SEQ ID NO: 191 - DNA, 31 bp, Artificial Sequence
  Synthetic construct
aatgatacctttagatctacatttcctcacc

SEQ ID NO: 192 - DNA, 25 bp, Artificial Sequence
  Synthetic construct
atttggccgccgagaatgagagact

SEQ ID NO: 193 - DNA, 23 bp, Artificial Sequence
  Synthetic construct
gcgaagcatggtaagggccgtgg

SEQ ID NO: 194 - DNA, 42 bp, Artificial Sequence
  Synthetic construct
gttttagagctagaaatagcaagttaaaataaggctagtccg

SEQ ID NO: 195 - DNA, 84 bp, Artificial Sequence
  Synthetic construct
gaagacaaaatgcgaagcatggtaagggccggttttagagctagaaatagcaagttaaaataaggctagtccgcttttgtcttc

SEQ ID NO: 196 - DNA, 84 bp, Artificial Sequence
  Synthetic construct
gaagacaaaagcggactagccttattttaacttgctatttctagctctaaaaccggcccttaccatgcttcgcattttgtcttc

SEQ ID NO: 197 - DNA, 5878 bp, Artificial Sequence
  Synthetic construct
ggaggctctgtacagtgaccggtgactctttctggcatgcggagagacggacggacgcagagagaagggctgagtaataagcgccactgcgccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgtgcttctaaggtatgagtcgcaaaattgttttttatttttggtcttgagtctaatatgctcgcagctcttgcgttgtatatggtcgttgtcgcgtattttctgttgtattaaaagatcaaacgagatcaagggatggctcgcgggctgtctctcgcactaggaggaagaatgcctgaaaaaggaactttgattttagctgtggaatagagatggcttgtttgaggacgcttgtcgcttggcgcagggacttgaatggcagcttgtggaaaccgaaggcgagaaaagtcgacggatactgtacgtggttctattgccagtgcggtggaagcttccttctcatatagttcaatccttctttgaatctgtttgtttcatatttggactgtttcattctctgcttgcgcattctcatcttcgagaacgactgcagggattgttggttctgtggagctgatgagcgcgccttgaccacccttgttcttgttttgctcttttgttctcatttaacccgtttctcccttccaaccctttgaccttgcaacattgtctcccagcgcgttgccaaagcgaacttgatatcagtatagtatgaccaagtagtctaccaaaataaattttagtacagtattgctagttatacaagataaattttgtacaacaatgattatgcagagctggtattctgtaaggagtaaattcatgcaggtacagagcgtccacgtcaggcacacgcgctttagtgctgggtacacattatgctacctttggggcaaggtgctattctaggtagggtatgcctagcaatgccatgatcttatgacctcagtaatctgaccttggatttaagatcggagttctcaaaccctgcgcgct

SEQ ID NO: 198 - DNA, 1474 bp, Artificial Sequence
  Synthetic construct
ggagtggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggcgaagcatggtaagggccgtttagagctagaaatagcaagttaaaataaggctagtccggcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacatcgct

SEQ ID NO: 199 - DNA, 1995 bp, Artificial Sequence
  Synthetic construct
ggagtctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaataatggcgaagcatggtaagggccgtttagagctagaaatagcaagttaaaataaggctagtccggcttatagagcttgagtatgcgtttccggtagatattattttggtcatatggactatccctctataccacttcatctgttttgttgtttgtattgtgtcagtcagtttctgagctattttccctccaaaagggctatattaagtccaagttgtaccacctatctttaccagctttgattcgaagtgagggacattggaatatgagatgagagatgtggctagactccatatacatttatgcacagaactgtcgatatagtatgtccatgcacgggtttgcctatatatattatctaggatatcagatgggtaaacccatcaccattccaagtttgagacaattaagaagcccatatatattcatcatgtagatatatctttctccagatgttgatatgtaccatccaattgctgttctttgatagtatgtgattgcatcatctttttgaggaaagctggtgcagtagagaatatcatatctagagaatgcataatcaagctggcatcaatactctacattacctggtaaagctaaccgactggtcaccactaagatgcaaccctaactaggtaccgtacctagacgggtagtaggtagtcttatgtaatgcactttcacgtgcctacccatgttattactctaaaataggcaggcggtgtatttctgccagaaagtggggttaaattgaactttaaggctacacattttgcccttcggggcatatggtcaactgaaaatatacagagaagattagcatggcccctgcactaaggatgacacgctcaatcaaagagaagctaccaatttttttttcccttacagaccctgtattgaggatctagggtgtgggtctttttgcagtatctggttggtcctgccagatatcgagtcacgtgataatgtccaataacgtcgtgggttccgct

SEQ ID NO: 200 - DNA, 1239 bp, Artificial Sequence
  Synthetic construct
ggaggaccctcactaggttcaatggtggcaacaagtcaccatttctgtattagaggactattacagtcttacttccttcccctcttcacagtctccacactgtcccaatattaacgtattgtgtacctttatgatctcatccactctgtagatctcaacagtctgcccagctgctgccatcccatagatgccgtggtcctttttcccgattctgaagcgatgcatgtgcccgtaggctttgattagattagcttcctaaaatattgcaacgagacaagacacaccctcttattaaagggtgtgtctagtgttaatctcactagcgtcacatgacctttccccatgtacatagttcactcctactcttcttccttccctacacgcttaaaggtctgccactctgtacaataccactttgtacagcctctttatgacctcgttcacgtcgtagatcttatcctctagcgttgtatagatcgatcctaaaccacggcaccatcctagaaacctagaatacacaaaagctaaggtgcgtctatttgaattagtagagtaatatgtttccaaccaatcaatggcgaagcatggtaagggccgtttagagctagaaatagcaagttaaaataaggctagtccggcttttgtcttcgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacactcgccaacacccgctgacgcgccctgacgggcttgtctgctcccggcatccgcttacagacaagctgtgacgaagacaacgct

SEQ ID NO: 201 - DNA, 2076 bp, Artificial Sequence
  Synthetic construct
ggagcacagtggctgttagggcaagacgtctagaggatgttctcctttgaacgtctttttagcgaaatgctgtatatttttgctcaaaggccccggggatacatattaaaactgcaataaatgctcatctgtggcatgtgccatgattctttgtggctttgtggtgagtggtggatgtgttagtagcctactaaacctgactatattgactgctactagtataattgttaacaaacaaaccgctttcttagaacataacctactgaccatgccagggcgtaataatagaagaatacataagatgtatggctattgtcaccgaatacaaagattgatttattgataacctttacctttgaggtttgcggataactgatgaagagtgtgaggatccatcagcatgatagcacagcattaacgacaggaccttctatggttttatcattgaactacctggttatggaaacggagagccagatggaaaaggagagggtcccggacatctaagcaggagctttatatactatgttcacatttacttattggaagtattgtacaggctacctaaaatagaaaggtattcccacgtggcaacatatctgtatttctttttttatggctgttctcattcagatcggctttcagatctgatcattgccgtgtgtgattgatatcttctcattggcaccatggcagagtatcgacgaccaagaaaagtcgattcgtttgtctgatagtatctagctctccagtgggacctaggccatctactaggagaaatagcctagttaatagtctgatagggcgtttagtctcgaacgatatagcgtccgaataaattcccccattgtcaacttcctgaacagaacgaaattttgatataccacaaccctaaaaatttcgaccaaccacccgccaaaacgccaaaaatcacgcaattgagctaaagaaaaaagaaaaggcctcgttttgaggcggaacgggcaaaaattgcaaaaagaagaaatggcgaagcatggtaagggccgtttagagctagaaatagcaagttaaaataaggctagtccggctttaactttttgctttggaaacatccaggttgtcctccgtttcttctttattcttcatttttctcgtttggaaaaatagttgaatgatgtggtagtataatgcattgctggaagttccgcctatcttaggggctgagccctcctaaagggttatccatgttacttggcgtaagtagcaaagctgcgtttgctgtctagaatatttatagggattgtataaagatacctttgttgtttggctctattatgtacagtcgtttagccgaagtgatgggtattacgtctggttatattttcaatatatgatggtatatgactatatccaactggctaaccttctcttgggaacctaactgtcgttcccctcgacagatgagcagaagaaccagctcatctgtccaaaaagcccctaataaacttatgcacactagttgtcctaccaaccacatgtctacgataactacccctacacatgtaaggctgttcatgcactggggctagaagatacatacggatagccacacgtgcattgatgtcacaccctcgtgatggcagcaatgctaaagcaaacgtagcatgcagctgccaggggtcggacgtctgactttccaggcccgataatctgccaatttacgttccacatacctgcttaatattttagtcaaagggaactccggaaggaaagccacaggagtcaatacttacttagcatataactttgttgggagcacgcaaatgatgtttcctccaccggcatctagcgcttctatatgtagccagcctttttcgtagcatatcttcacgccgtcgtcgtctaggtcccgagggacgctcccctctggcagcacttttcgcaggattcgtgccacaggttgggatatccttttcgctaacaaacgagcgccacattgttgtccgtttcaaggggggaaaaagatcgaacgccttctcattctggtgcagagttctccggatgtcgacatcttcgatcttaagcttgttcgct

SEQ ID NO: 202 - DNA, 1005 bp, Artificial Sequence
  Synthetic construct
ggagcggccctcgccctcgccctcgatctcgaactcgtggccgttcacggagccctccatgcgcaccttgaagcgcatgaactccttgatgacgtcctcggaggaggccatggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagcgct

SEQ ID NO: 203 - DNA, 987 bp, Artificial Sequence
  Synthetic construct
ggaggtcgactacatgtatctgcatgttgcatcgggaaatcccaccacagggacagccaagcggccccgcgacttggcagtgggcaaactacgcccgattctggtgccaagaaccgagaagaatgagacagacccacgttgcactctaaccggatgctatcgacttacggtggctgaagattcaacacgctgcaacgagagccaaggtggtccggacattttctacgtgccggtttaccttggaacatcgccgtcgttgagtgcacgttgcctactctctcgtggcttggctgggcccacgagcccgattgactcgacggtgttacttgggtatctatggccccgttttctggcacggtaatgataagtacttactagttttcgagcgagcgggggagtgttgctctgcccgagcatcaacgattggcctgatcgcaccgtctgcaaatgccacggtgcggaccgactgaaatctcagaccaccaaagaccctccgacttcgagatacggttactaattttacactggctccagcggccccatccagtaagcatctgggctgcaagcgtataatgtctccaggttgtctcagcataaacaccccgcccccgctcaggcacacaggaagagagctcaggtcgtttccattgcgtccatactcttcactcattgtcatctgcaggagaacttcccctgtccctttgccaagccctctcttcgtcgttgtccacgccttcaagttttcaccattatttttctagacaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgcgct

SEQ ID NO: 204 - DNA, 14244 bp, Artificial Sequence
  Synthetic construct
gtgccgaattcggatccggagcggccctcgccctcgccctcgatctcgaactcgtggccgttcacggagccctccatgcgcaccttgaagcgcatgaactccttgatgacgtcctcggaggaggccatggatcctgtgatgtctgctcaagcggggtagctgttagtcaagctgcgatgaagtgggaaagctcgaactgaaaggttcaaaggaataagggatgggaaggatggagtatggatgtagcaaagtacttacttaggggaaataaaggttcttggatgggaagatgaatatactgaagatgggaaaagaaagagaaaagaaaagagcagctggtggggagagcaggaaaatatggcaacaaatgttggactgacgcaacgaccttgtcaaccccgccgacacaccgggcggacagacggggcaaagctgcctaccagggactgagggacctcagcaggtcgagtgcagagcaccggatgggtcgactgccagcttgtgttcccggtctgcgccgctggccagctcctgagcggcctttccggtttcatacaccgggcaaagcaggagaggcacgatatttggacgccctacagatgccggatgggccaattagggagcttacgcgccgggtactcgctctacctacttcggagaaggtactatctcgtgaatcttttaccagatcggaagcaattggacttctgtacctaggttaatggcatgctatttcgccgacggctatacacccctggcttcacattctccttcgcttactgccggtgattcgatgaagctccatattctccgatgatgcaatagattcttggtcaacgaggggcacaccagcctttccacttcggggcggaggggcggccggtcccggattaataatcatccactgcacctcagagccgccagagctgtctggcgcagtggcgcttattactcagcccttctctctgcgtccgtccgtctctccgcatgccagaaagagtcaccggtcactgtacagcgctgcaagaattcaagcttggaggctctgtacagtgaccggtgactctttctggcatgcggagagacggacggacgcagagagaagggctgagtaataagcgccactgcgccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagaccccaagaagaagaggaaggtgtgagcttgtgcttctaaggtatgagtcgcaaaattgttttttatttttggtcttgagtctaatatgctcgcagctcttgcgttgtatatggtcgttgtcgcgtattttctgttgtattaaaagatcaaacgagatcaagggatggctcgcgggctgtctctcgcactaggaggaagaatgcctgaaaaaggaactttgattttagctgtggaatagagatggcttgtttgaggacgcttgtcgcttggcgcagggacttgaatggcagcttgtggaaaccgaaggcgagaaaagtcgacggatactgtacgtggttctattgccagtgcggtggaagcttccttctcatatagttcaatccttctttgaatctgtttgtttcatatttggactgtttcattctctgcttgcgcattctcatcttcgagaacgactgcagggattgttggttctgtggagctgatgagcgcgccttgaccacccttgttcttgttttgctcttttgttctcatttaacccgtttctcccttccaaccctttgaccttgcaacattgtctcccagcgcgttgccaaagcgaacttgatatcagtatagtatgaccaagtagtctaccaaaataaattttagtacagtattgctagttatacaagataaattttgtacaacaatgattatgcagagctggtattctgtaaggagtaaattcatgcaggtacagagcgtccacgtcaggcacacgcgctttagtgctgggtacacattatgctacctttggggcaaggtgctattctaggtagggtatgcctagcaatgccatgatcttatgacctcagtaatctgaccttggatttaagatcggagttctcaaaccctgcgcgctactagaattcgagctcggagtggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggcgaagcatggtaagggccgtttagagctagaaatagcaagttaaaataaggctagtccggcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacatcgctttacgaattcccatggggaggtcgactacatgtatctgcatgttgcatcgggaaatcccaccacagggacagccaagcggccccgcgacttggcagtgggcaaactacgcccgattctggtgccaagaaccgagaagaatgagacagacccacgttgcactctaaccggatgctatcgacttacggtggctgaagattcaacacgctgcaacgagagccaaggtggtccggacattttctacgtgccggtttaccttggaacatcgccgtcgttgagtgcacgttgcctactctctcgtggcttggctgggcccacgagcccgattgactcgacggtgttacttgggtatctatggccccgttttctggcacggtaatgataagtacttactagttttcgagcgagcgggggagtgttgctctgcccgagcatcaacgattggcctgatcgcaccgtctgcaaatgccacggtgcggaccgactgaaatctcagaccaccaaagaccctccgacttcgagatacggttactaattttacactggctccagcggccccatccagtaagcatctgggctgcaagcgtataatgtctccaggttgtctcagcataaacaccccgcccccgctcaggcacacaggaagagagctcaggtcgtttccattgcgtccatactcttcactcattgtcatctgcaggagaacttcccctgtccctttgccaagccctctcttcgtcgttgtccacgccttcaagttttcaccattatttttctagacaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgcgctcagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaagcttctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaacagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggctccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 205 - DNA, 23 bp, Artificial Sequence
  Synthetic construct
gtcaatgcgctctctagagctgg

SEQ ID NO: 206 - DNA, 84 bp, Artificial Sequence
  Synthetic construct
gaagacaaaatgtcaatgcgctctctagagcgttttagagctagaaatagcaagttaaaataaggctagtccgcttttgtcttc

SEQ ID NO: 207 - DNA, 84 bp, Artificial Sequence
  Synthetic construct
gaagacaaaagcggactagccttattttaacttgctatttctagctctaaaacgctctagagagcgcattgacattttgtcttc

SEQ ID NO: 208 - DNA, 1474 bp, Artificial Sequence
  Synthetic construct
ggagtggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggtcaatgcgctctctagagctttagagctagaaatagcaagttaaaataaggctagtccggcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacatcgct

SEQ ID NO: 209 - DNA, 120 bp, Artificial Sequence
  Synthetic construct
cgttttaccagtatcgttgatctcctcgcgaggttctaatagtcagggccaaactcagctctagagagcgcattgacgacaatttaccaattggggtgtttcatccactactatggtgat

SEQ ID NO: 210 - DNA, 78 bp, Artificial Sequence
  Synthetic construct
gttttagagctagaaatagcaagttaaaataaggctagtccgttatcaacttgaaaaagtggcaccgagtcggtgctg

SEQ ID NO: 211 - DNA, 120 bp, Artificial Sequence
  Synthetic construct
gaagacaaaatgtcaatgcgctctctagagcgttttagagctagaaatagcaagttaaaataaggctagtccgttatcaacttgaaaaagtggcaccgagtcggtgctgcttttgtcttc

SEQ ID NO: 212 - DNA, 120 bp, Artificial Sequence
  Synthetic construct
gaagacaaaagcagcaccgactcggtgccactttttcaagttgataacggactagccttattttaacttgctatttctagctctaaaacgctctagagagcgcattgacattttgtcttc

SEQ ID NO: 213 - DNA, 1000 bp, Artificial Sequence
  Synthetic construct
tggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacct

SEQ ID NO: 214 - DNA, 398 bp, Artificial Sequence
  Synthetic construct
gctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacat

SEQ ID NO: 215 - DNA, 1503 bp, Artificial Sequence
  Synthetic construct
tggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggtcaatgcgctctctagagcgttttagagctagaaatagcaagttaaaataaggctagtccgttatcaacttgaaaaagtggcaccgagtcggtgctgcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacat

SEQ ID NO: 216 - DNA, 569 bp, Artificial Sequence
  Synthetic construct
gaccctcactaggttcaatggtggcaacaagtcaccatttctgtattagaggactattacagtcttacttccttcccctcttcacagtctccacactgtcccaatattaacgtattgtgtacctttatgatctcatccactctgtagatctcaacagtctgcccagctgctgccatcccatagatgccgtggtcctttttcccgattctgaagcgatgcatgtgcccgtaggctttgattagattagcttcctaaaatattgcaacgagacaagacacaccctcttattaaagggtgtgtctagtgttaatctcactagcgtcacatgacctttccccatgtacatagttcactcctactcttcttccttccctacacgcttaaaggtctgccactctgtacaataccactttgtacagcctctttatgacctcgttcacgtcgtagatcttatcctctagcgttgtatagatcgatcctaaaccacggcaccatcctagaaacctagaatacacaaaagctaaggtgcgtctatttgaattagtagagtaatatgtttccaaccaatc

SEQ ID NO: 217 - DNA, 223 bp, Artificial Sequence
  Synthetic construct
tcgatcttttttttcgccttattatcgattctccggcttcatattatctccgattctactcacaccaacctaggtagccttacagcttcctatgtcaaacgggaattagctatgttttataaagtctgttgtaaaagacggtcaagtctgttgtaaaagacggtcaagtctttagactcaccatcattttgatcgccctacaaatagatagaacttgggaaga

SEQ ID NO: 218 - DNA, 897 bp, Artificial Sequence
  Synthetic construct
gaccctcactaggttcaatggtggcaacaagtcaccatttctgtattagaggactattacagtcttacttccttcccctcttcacagtctccacactgtcccaatattaacgtattgtgtacctttatgatctcatccactctgtagatctcaacagtctgcccagctgctgccatcccatagatgccgtggtcctttttcccgattctgaagcgatgcatgtgcccgtaggctttgattagattagcttcctaaaatattgcaacgagacaagacacaccctcttattaaagggtgtgtctagtgttaatctcactagcgtcacatgacctttccccatgtacatagttcactcctactcttcttccttccctacacgcttaaaggtctgccactctgtacaataccactttgtacagcctctttatgacctcgttcacgtcgtagatcttatcctctagcgttgtatagatcgatcctaaaccacggcaccatcctagaaacctagaatacacaaaagctaaggtgcgtctatttgaattagtagagtaatatgtttccaaccaatcaatggtcaatgcgctctctagagcgttttagagctagaaatagcaagttaaaataaggctagtccgttatcaacttgaaaaagtggcaccgagtcggtgctgctttcgatcttttttttcgccttattatcgattctccggcttcatattatctccgattctactcacaccaacctaggtagccttacagcttcctatgtcaaacgggaattagctatgttttataaagtctgttgtaaaagacggtcaagtctgttgtaaaagacggtcaagtctttagactcaccatcattttgatcgccctacaaatagatagaacttgggaaga

SEQ ID NO: 219 - DNA, 1000 bp, Artificial Sequence
  Synthetic construct
cacagtggctgttagggcaagacgtctagaggatgttctcctttgaacgtctttttagcgaaatgctgtatatttttgctcaaaggccccggggatacatattaaaactgcaataaatgctcatctgtggcatgtgccatgattctttgtggctttgtggtgagtggtggatgtgttagtagcctactaaacctgactatattgactgctactagtataattgttaacaaacaaaccgctttcttagaacataacctactgaccatgccagggcgtaataatagaagaatacataagatgtatggctattgtcaccgaatacaaagattgatttattgataacctttacctttgaggtttgcggataactgatgaagagtgtgaggatccatcagcatgatagcacagcattaacgacaggaccttctatggttttatcattgaactacctggttatggaaacggagagccagatggaaaaggagagggtcccggacatctaagcaggagctttatatactatgttcacatttacttattggaagtattgtacaggctacctaaaatagaaaggtattcccacgtggcaacatatctgtatttctttttttatggctgttctcattcagatcggctttcagatctgatcattgccgtgtgtgattgatatcttctcattggcaccatggcagagtatcgacgaccaagaaaagtcgattcgtttgtctgatagtatctagctctccagtgggacctaggccatctactaggagaaatagcctagttaatagtctgatagggcgtttagtctcgaacgatatagcgtccgaataaattcccccattgtcaacttcctgaacagaacgaaattttgatataccacaaccctaaaaatttcgaccaaccacccgccaaaacgccaaaaatcacgcaattgagctaaagaaaaaagaaaaggcctcgttttgaggcggaacgggcaaaaattgcaaaaagaaga

SEQ ID NO: 220 - DNA, 1000 bp, Artificial Sequence
  Synthetic construct
taactttttgctttggaaacatccaggttgtcctccgtttcttctttattcttcatttttctcgtttggaaaaatagttgaatgatgtggtagtataatgcattgctggaagttccgcctatcttaggggctgagccctcctaaagggttatccatgttacttggcgtaagtagcaaagctgcgtttgctgtctagaatatttatagggattgtataaagatacctttgttgtttggctctattatgtacagtcgtttagccgaagtgatgggtattacgtctggttatattttcaatatatgatggtatatgactatatccaactggctaaccttctcttgggaacctaactgtcgttcccctcgacagatgagcagaagaaccagctcatctgtccaaaaagcccctaataaacttatgcacactagttgtcctaccaaccacatgtctacgataactacccctacacatgtaaggctgttcatgcactggggctagaagatacatacggatagccacacgtgcattgatgtcacaccctcgtgatggcagcaatgctaaagcaaacgtagcatgcagctgccaggggtcggacgtctgactttccaggcccgataatctgccaatttacgttccacatacctgcttaatattttagtcaaagggaactccggaaggaaagccacaggagtcaatacttacttagcatataactttgttgggagcacgcaaatgatgtttcctccaccggcatctagcgcttctatatgtagccagcctttttcgtagcatatcttcacgccgtcgtcgtctaggtcccgagggacgctcccctctggcagcacttttcgcaggattcgtgccacaggttgggatatccttttcgctaacaaacgagcgccacattgttgtccgtttcaaggggggaaaaagatcgaacgccttctcattctggtgcagagttctccggatgtcgacatcttcgatcttaagcttgtt

SEQ ID NO: 221 - DNA, 2105 bp, Artificial Sequence
  Synthetic construct
cacagtggctgttagggcaagacgtctagaggatgttctcctttgaacgtctttttagcgaaatgctgtatatttttgctcaaaggccccggggatacatattaaaactgcaataaatgctcatctgtggcatgtgccatgattctttgtggctttgtggtgagtggtggatgtgttagtagcctactaaacctgactatattgactgctactagtataattgttaacaaacaaaccgctttcttagaacataacctactgaccatgccagggcgtaataatagaagaatacataagatgtatggctattgtcaccgaatacaaagattgatttattgataacctttacctttgaggtttgcggataactgatgaagagtgtgaggatccatcagcatgatagcacagcattaacgacaggaccttctatggttttatcattgaactacctggttatggaaacggagagccagatggaaaaggagagggtcccggacatctaagcaggagctttatatactatgttcacatttacttattggaagtattgtacaggctacctaaaatagaaaggtattcccacgtggcaacatatctgtatttctttttttatggctgttctcattcagatcggctttcagatctgatcattgccgtgtgtgattgatatcttctcattggcaccatggcagagtatcgacgaccaagaaaagtcgattcgtttgtctgatagtatctagctctccagtgggacctaggccatctactaggagaaatagcctagttaatagtctgatagggcgtttagtctcgaacgatatagcgtccgaataaattcccccattgtcaacttcctgaacagaacgaaattttgatataccacaaccctaaaaatttcgaccaaccacccgccaaaacgccaaaaatcacgcaattgagctaaagaaaaaagaaaaggcctcgttttgaggcggaacgggcaaaaattgcaaaaagaagaaatggtcaatgcgctctctagagcgttttagagctagaaatagcaagttaaaataaggctagtccgttatcaacttgaaaaagtggcaccgagtcggtgctgctttaactttttgctttggaaacatccaggttgtcctccgtttcttctttattcttcatttttctcgtttggaaaaatagttgaatgatgtggtagtataatgcattgctggaagttccgcctatcttaggggctgagccctcctaaagggttatccatgttacttggcgtaagtagcaaagctgcgtttgctgtctagaatatttatagggattgtataaagatacctttgttgtttggctctattatgtacagtcgtttagccgaagtgatgggtattacgtctggttatattttcaatatatgatggtatatgactatatccaactggctaaccttctcttgggaacctaactgtcgttcccctcgacagatgagcagaagaaccagctcatctgtccaaaaagcccctaataaacttatgcacactagttgtcctaccaaccacatgtctacgataactacccctacacatgtaaggctgttcatgcactggggctagaagatacatacggatagccacacgtgcattgatgtcacaccctcgtgatggcagcaatgctaaagcaaacgtagcatgcagctgccaggggtcggacgtctgactttccaggcccgataatctgccaatttacgttccacatacctgcttaatattttagtcaaagggaactccggaaggaaagccacaggagtcaatacttacttagcatataactttgttgggagcacgcaaatgatgtttcctccaccggcatctagcgcttctatatgtagccagcctttttcgtagcatatcttcacgccgtcgtcgtctaggtcccgagggacgctcccctctggcagcacttttcgcaggattcgtgccacaggttgggatatccttttcgctaacaaacgagcgccacattgttgtccgtttcaaggggggaaaaagatcgaacgccttctcattctggtgcagagttctccggatgtcgacatcttcgatcttaagcttgtt

SEQ ID NO: 222 - DNA, 1000 bp, Artificial Sequence
  Synthetic construct
tctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaat

SEQ ID NO: 223 - DNA, 919 bp, Artificial Sequence
  Synthetic construct
atagagcttgagtatgcgtttccggtagatattattttggtcatatggactatccctctataccacttcatctgttttgttgtttgtattgtgtcagtcagtttctgagctattttccctccaaaagggctatattaagtccaagttgtaccacctatctttaccagctttgattcgaagtgagggacattggaatatgagatgagagatgtggctagactccatatacatttatgcacagaactgtcgatatagtatgtccatgcacgggtttgcctatatatattatctaggatatcagatgggtaaacccatcaccattccaagtttgagacaattaagaagcccatatatattcatcatgtagatatatctttctccagatgttgatatgtaccatccaattgctgttctttgatagtatgtgattgcatcatctttttgaggaaagctggtgcagtagagaatatcatatctagagaatgcataatcaagctggcatcaatactctacattacctggtaaagctaaccgactggtcaccactaagatgcaaccctaactaggtaccgtacctagacgggtagtaggtagtcttatgtaatgcactttcacgtgcctacccatgttattactctaaaataggcaggcggtgtatttctgccagaaagtggggttaaattgaactttaaggctacacattttgcccttcggggcatatggtcaactgaaaatatacagagaagattagcatggcccctgcactaaggatgacacgctcaatcaaagagaagctaccaatttttttttcccttacagaccctgtattgaggatctagggtgtgggtctttttgcagtatctggttggtcctgccagatatcgagtcacgtgataatgtccaataacgtcgtgggttc

SEQ ID NO: 224 - DNA, 2024 bp, Artificial Sequence
  Synthetic construct
tctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaataatggtcaatgcgctctctagagcgttttagagctagaaatagcaagttaaaataaggctagtccgttatcaacttgaaaaagtggcaccgagtcggtgctgcttatagagcttgagtatgcgtttccggtagatattattttggtcatatggactatccctctataccacttcatctgttttgttgtttgtattgtgtcagtcagtttctgagctattttccctccaaaagggctatattaagtccaagttgtaccacctatctttaccagctttgattcgaagtgagggacattggaatatgagatgagagatgtggctagactccatatacatttatgcacagaactgtcgatatagtatgtccatgcacgggtttgcctatatatattatctaggatatcagatgggtaaacccatcaccattccaagtttgagacaattaagaagcccatatatattcatcatgtagatatatctttctccagatgttgatatgtaccatccaattgctgttctttgatagtatgtgattgcatcatctttttgaggaaagctggtgcagtagagaatatcatatctagagaatgcataatcaagctggcatcaatactctacattacctggtaaagctaaccgactggtcaccactaagatgcaaccctaactaggtaccgtacctagacgggtagtaggtagtcttatgtaatgcactttcacgtgcctacccatgttattactctaaaataggcaggcggtgtatttctgccagaaagtggggttaaattgaactttaaggctacacattttgcccttcggggcatatggtcaactgaaaatatacagagaagattagcatggcccctgcactaaggatgacacgctcaatcaaagagaagctaccaatttttttttcccttacagaccctgtattgaggatctagggtgtgggtctttttgcagtatctggttggtcctgccagatatcgagtcacgtgataatgtccaataacgtcgtgggttc

SEQ ID NO: 225 - DNA, 37 bp, Artificial Sequence
  Synthetic construct
ttgaagacttggagtcgatggcttgagaacatctggg

SEQ ID NO: 226 - DNA, 39 bp, Artificial Sequence
  Synthetic construct
gcgaagacaattttagtctccccagtggcgaattattgg

SEQ ID NO: 227 - DNA, 37 bp, Artificial Sequence
  Synthetic construct
ttgaagacttaaaagagcattgcattttggggctgcg

SEQ ID NO: 228 - DNA, 39 bp, Artificial Sequence
  Synthetic construct
aagaagacgtagcgcagatgaaacacatccacggaagtg

SEQ ID NO: 229 - DNA, 31 bp, Artificial Sequence; identical to SEQ ID NO: 191
  Synthetic construct

SEQ ID NO: 230 - DNA, 25 bp, Artificial Sequence
  Synthetic construct
atttggccgccgagaatgagagact

SEQ ID NO: 231 - DNA, 2049 bp, Artificial Sequence
  Synthetic construct
aatgatacctttagatctacatttcctcaccccattagtaagatatctgcagatactgttgataatcggtttctatactcgaatcgtggattcacatccctcgacgattttatgctgtctgacggggttattccatacttagcatgctgttgctatggcttctgaaatttaagagaaagaatcccctttaaggcgttctaatgcacattgatgcattgaaatttcttgtctaaagaactgggaggttggtttacgtagggcaaacaaagtcacgtgtcacatagcaacagtgctgtaaccttccgaatgcagcgacatcatttctttcattgcaacttcatcgtaatttttcttcggaacaggtctcttgtctatgatcccactatctcatgacaggctctccacggatagctcggctcactgcccatcttaatacttgatttctgcagtcattgcttgttttatccgcaaacagcacacacgcatcctggaactatcatcggtttgccggcagctttagtaactcggacccataatctagggtccaatcgggttatccaaggaaccaagcttttagttcggtccagcccatctccacttaggctctgtaaggcagacatactgaactctgggagtcatggaatctactgcagtaacggtaccattgttcagttttggggtacacatcagtacgagaaatacgagatctatagacttcactgattactggagaataagtcgcgggaacatacattcccaaaggtttcagctgggttaccataccatataaccctgattcccaagaaaaagaacctggaactaaaactcttccatttcctgcttagatacttctaagaaaattggaaggaagtcattaacttgctaccgacccacttcagggaaaatactcccgtcacatcctttataaagtaagatatccgtcaatttgcgccgggcgtaaactttccttctttctccatatacgcctgaaaccaataattcgccactggggagactaaaagagcattgcattttggggctgcgcgtgcctacttccaggacatttgtatatgggtccttttctctttgtttgtccattttgtatgctgctgtccgggttctttctttcctccctgtctttgtatcttagtctatacataatcccataattctgcggtttgctactcttgggttacattttaattaccgaatatgaataccagattgatattttacatttggaagcgttgtttttattttaaaaggtataaaatgaatggctagagtaaatccaacactgaaggggaacaggtgcagcctagaaatcgaacgaaccaagatgtctgtcattggagctatgatgaaaagaattgctatgaaaaacgaatggaacagcagcacttggagagaacacaagactcagataccgttgcatccgagacccgctttattcttgcgaaacgaaaatcgctcatgggtaaatgggaaagtcgcaatggatgaaggatgaaacgccaggaagatgcaatgtcgtaacgagcggatgaaaggaataaagatctggctaaggtgattgtgaaatgcttcgcaaagagcaaataccccgtctatgtatcgtgtctagacatcatagattggccggggcgagggaaaacacacgccaagaacatgaggcgtgggaaacccggagaaatcgagtgatgtcttagaaaggcatctctgagctgtatcgtaacgcactgcccctacccccaatcccgccattaccgttgccattattaccaacccccgggctggtcggacggctgccggcccacttggggcttcgtggttgagtgctagttgagcgagtcgatggacgattcttccggatttcacgaagctcatcttcctttctgcgtaggaattcgtcgcgcgtggccagaattaattctagctcttcgattcgagctatatgacgaactgactcgtccttcatgtgtaactcactaagtcggacggcattgctctcagccttgcgctttagtctctcattctcggcggccaaat

SEQ ID NO: 232 - DNA, 5112 bp, Artificial Sequence
  Synthetic construct
tcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcagga

SEQ ID NO: 233 - DNA, 12606 bp, Artificial Sequence
  Synthetic construct
cccccctcgaggtcgactacatgtatctgcatgttgcatcgggaaatcccaccacagggacagccaagcggccccgcgacttggcagtgggcaaactacgcccgattctggtgccaagaaccgagaagaatgagacagacccacgttgcactctaaccggatgctatcgacttacggtggctgaagattcaacacgctgcaacgagagccaaggtggtccggacattttctacgtgccggtttaccttggaacatcgccgtcgttgagtgcacgttgcctactctctcgtggcttggctgggcccacgagcccgattgactcgacggtgttacttgggtatctatggccccgttttctggcacggtaatgataagtacttactagtcttcgagcgagcgggggagtgttgctctgcccgagcatcaacgattggcctgatcgcaccgtctgcaaatgccacggtgcggaccgactgaaatctcagaccaccaaagaccctccgacttcgagatacggttactaattttacactggctccagcggccccatccagtaagcatctgggctgcaagcgtataatgtctccaggttgtctcagcataaacaccccgcccccgctcaggcacacaggaagagagctcaggtcgtttccattgcgtccatactcttcactcattgtcatctgcaggagaacttcccctgtccctttgccaagccctctcttcgtcgttgtccacgccttcaagttttcaccattatttttctagacaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgacgccgaccaacaccgccggtccgacgcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagcttattttttgtatactgttttgtgatagcacgaagtttttccacggtatcttgtaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaaacaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgccataaagagtggctagaggttataaattagcactgatcctaggtacggggctgaatgtaacttgcctttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgactcccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggaccattgtgcaatgtaaactccatgccgtgggagttcttgtccttcaagtgcttgaccaatatgtttctgttggcagagggaacctgtcaactagttaataactagtcagaaactatgatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgttatcgcgaatgctcggcatactaactgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaagagatttcgactagttatgtacctggagtttggatataggaatgtgttgtggtaacgaaatgtaagggggaggaaagaaaaagtcgtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcccaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaacggtgagagtccagtggtcgcagataactccctaaattccctgagctaactctaagtcgaccatgccgtttatggttagcgcctcccaaaaaggaatggccgacttagagttacctcttgacgactttttctttcctcccccttacatttcgttaccacaacacattcctatatccaaactccaggtacataactagtcgaaatctctttaaatctagtcaagaactagatacttaaccttcatactgcttagagatagcctttgaagctcttatttcgctctttgtctcactctcaccttcctcctcctcctccaatcctttttgctcgggactagtccaagactagtcaacagttagtatgccgagcattcgcgataacgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatcatagtttctgactagttattaactagttgacaggttccctctgccaacagaaacatattggtcaagcacttgaaggacaagaactcccacggcatggagtttacattgcacaatggtcctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggagtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaaaggcaagttacattcagccccgtacctaggatcagtgctaatttataacctctagccactctttatggcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttacaagataccgtggaaaaacttcgtgctatcacaaaacagtatacaaaaaataagaccgatatcgaattcctgcagagatcatcctgtcttcagtcttaagacttctctcctatatcacccgcacttaccctagagtgccgcttaggtgctaagggcacattgagtattggccgtgtagaatatatagcttaagtacggccaagcagacgggaagccctgttctccacaccctatggtcgtatatatcaggcttctaccgggaaacgattaagagtgtataatggactgaaaatcaatatgaacgggacaatgctcaagttaaattagttaggcatcctaatctctactaaatgttctatctagagatcggggtactataggcccgtacgttaatcactctacgcttctctcccttaggtatagtgtaggtaggggctagacatttatatgagtcagatggtacaaacggtaggcagtgcgggcgaagaagtgaagacggagtcggttgaagctacatacaaaagatgcattggctcgtcatgaagagcctacggtgtcccaatttactaggcaaatcacaataacgtgcgacggctacttcgtgctgttcaacataagtttccttatctgcttctttgatacgttctaaacgacgatcgacgtagtaaacaccaggcatcttaagattcttagctggctttttagaacggtatgtggttttcaaattacagataaggtgacctccaccgacaagtttcaatgccatatcagcacgaccttccaatccaccatcggcaggatataatgtttcggtagatgcttcccatccaagggtctttttctgcataacaggaccattacttggaaaattaactccacggatctttacattgtagataagacaaccatcttgcaaagatgtatcttgagttgctgtcaatactccaccatcttcataagttgtgacacgttcccatgtaaatccttcaggaaatgactgtttaaagaaatctgggataccttgggtatgattgataaaagtctttgatccgtacataaaagatgtagcaagaatatcaaaggcaaaaggcaatggtccaccttcaacggccttaatacgcatggtttgagtaccttcatatggttttccttctccttctgaggtacatttaaagtggtgattatttactgttccttccatgtacaatttcatgtgcatattttccttgataagttctgacatggatccgagttatagacggtccggcataggtaaggagagattagatatttcgacttcccgattccttagtctccttagtctggaaactgagaaaggcctgaactcgttcaatctattagctctaatcacgtagtctcaactagaatcctgaacaggcgccggaaccagtccaaatgcgtggagtacagcaagtccagtcaaatcacgattagaatggccatatataagcaaaaaacccttggacaatacgtccgatcgagaccaaagcaatctggtacatcacccttcttatatacagggtagccggaattgtattgactctatacgaagccgcaggtttaccagcacagaggtgcgatagctacacgaatgtagagtgaaggcattacaaccgattgctaagtgtcatagaggctaagcttcacggctcaaggagtctgtggaggagacctgatataagaattgagagttatactccggaggttatgttagtacctcaaaaatgtgaagtacaacgaaactcgaacttcgaatgacaatagcttggctggctgttagtcaactgaggtacaacgtcatcttgcaattagttatgttctttgctagatagtgagctgctgtaaacttgtagttcttagaaacatgtctgaagtctagagtcgagacttgtgattggtgtaaattagtgggggtccggagcggaataacaatcgaggtcagcctcctgggtctgtcagtaagctaaccacgaaaggacaagcgtagacgaggtcacggggtactggcctagccggcttcggctagcgcccacgaaaatagggcaacgtcgaagcgagagacacacacggattccacgatcgccgacgacaagcactcaactccacgacaacccacgacaacccttgccgctgcgttcttggtgaagggctgcaggattagaggtgagtattttattttctggctattgtgatctttttcccccccggtttccgctggttctatcttgtcgagcgagtcggtgcgccttcgatcggtctgtcaaatttccatccgtccactcgttcacccggtatcgatacaagagggaatggagcattacgacaggggagcagaggcagaactctcgatgttgctactttttttgcttggaacaacttccttgaaagattcttttctgaatgcggctgggaaactgcgaattggatatccagcgaaaggttaccgacagactcacggccatcgataccactcagcgggatagaattgaaggcattcggacattagatgatcagcttcgcttgtttcgactcgtgctaatcaattatccctggacagtcccccacatagacagcaaacgcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttcgaccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcctttttttctgatcaaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtaccgggc

SEQ ID NO: 234 - DNA, 32 bp, Artificial Sequence
  Synthetic construct
ttgaagacaaggagggccgccaccgcggtgga

SEQ ID NO: 235 - DNA, 43 bp, Artificial Sequence
  Synthetic construct
ttgaagacaaagcgcattggaaaacgttcttcggggcgaaaac

SEQ ID NO: 236 - DNA, 1028 bp, Artificial Sequence
  Synthetic construct
ttgaagacaaggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctttgtcttcaa

SEQ ID NO: 237 - DNA, 34 bp, Artificial Sequence
  Synthetic construct
ttgaagacaaggagaaaaaccaccgctaccagcg

SEQ ID NO: 238 - DNA, 37 bp, Artificial Sequence
  Synthetic construct
ttgaagacaaagcgccggtacccagcttttgttccct

SEQ ID NO: 239 - DNA, 1034 bp, Artificial Sequence
  Synthetic construct
ttgaagacaaggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtaccggcgctttgtcttcaa

SEQ ID NO: 240 - DNA, 12491 bp, Artificial Sequence
  Synthetic construct
gtgccgaattcggatccggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctgcaagaattcaagcttggagtcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcaggacgctactagaattcgagctcggagtctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaataatggtcaatgcgctctctagagcgttttagagctagaaatagcaagttaaaataaggctagtccgttatcaacttgaaaaagtggcaccgagtcggtgctgcttatagagcttgagtatgcgtttccggtagatattattttggtcatatggactatccctctataccacttcatctgttttgttgtttgtattgtgtcagtcagtttctgagctattttccctccaaaagggctatattaagtccaagttgtaccacctatctttaccagctttgattcgaagtgagggacattggaatatgagatgagagatgtggctagactccatatacatttatgcacagaactgtcgatatagtatgtccatgcacgggtttgcctatatatattatctaggatatcagatgggtaaacccatcaccattccaagtttgagacaattaagaagcccatatatattcatcatgtagatatatctttctccagatgttgatatgtaccatccaattgctgttctttgatagtatgtgattgcatcatctttttgaggaaagctggtgcagtagagaatatcatatctagagaatgcataatcaagctggcatcaatactctacattacctggtaaagctaaccgactggtcaccactaagatgcaaccctaactaggtaccgtacctagacgggtagtaggtagtcttatgtaatgcactttcacgtgcctacccatgttattactctaaaataggcaggcggtgtatttctgccagaaagtggggttaaattgaactttaaggctacacattttgcccttcggggcatatggtcaactgaaaatatacagagaagattagcatggcccctgcactaaggatgacacgctcaatcaaagagaagctaccaatttttttttcccttacagaccctgtattgaggatctagggtgtgggtctttttgcagtatctggttggtcctgccagatatcgagtcacgtgataatgtccaataacgtcgtgggttccgctttacgaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 241 - DNA, 13071 bp, Artificial Sequence
  Synthetic construct
gtgccgaattcggatccggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctgcaagaattcaagcttggagtcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcaggacgctactagaattcgagctcggagtctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaataatggtcaatgcgctctctagagcgttttagagctagaaatagcaagttaaaataaggctagtccgttatcaacttgaaaaagtggcaccgagtcggtgctgctttggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggtcaatgcgctctctagagcgttttagagctagaaatagcaagttaaaataaggctagtccgttatcaacttgaaaaagtggcaccgagtcggtgctgcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacatttacgaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 242 - DNA, 12568 bp, Artificial Sequence
  Synthetic construct
gtgccgaattcggatccggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctgcaagaattcaagcttggagtcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcaggacgctactagaattcgagctcggagcacagtggctgttagggcaagacgtctagaggatgttctcctttgaacgtctttttagcgaaatgctgtatatttttgctcaaaggccccggggatacatattaaaactgcaataaatgctcatctgtggcatgtgccatgattctttgtggctttgtggtgagtggtggatgtgttagtagcctactaaacctgactatattgactgctactagtataattgttaacaaacaaaccgctttcttagaacataacctactgaccatgccagggcgtaataatagaagaatacataagatgtatggctattgtcaccgaatacaaagattgatttattgataacctttacctttgaggtttgcggataactgatgaagagtgtgaggatccatcagcatgatagcacagcattaacgacaggaccttctatggttttatcattgaactacctggttatggaaacggagagccagatggaaaaggagagggtcccggacatctaagcaggagctttatatactatgttcacatttacttattggaagtattgtacaggctacctaaaatagaaaggtattcccacgtggcaacatatctgtatttctttttttatggctgttctcattcagatcggctttcagatctgatcattgccgtgtgtgattgatatcttctcattggcaccatggcagagtatcgacgaccaagaaaagtcgattcgtttgtctgatagtatctagctctccagtgggacctaggccatctactaggagaaatagcctagttaatagtctgatagggcgtttagtctcgaacgatatagcgtccgaataaattcccccattgtcaacttcctgaacagaacgaaattttgatataccacaaccctaaaaatttcgaccaaccacccgccaaaacgccaaaaatcacgcaattgagctaaagaaaaaagaaaaggcctcgttttgaggcggaacgggcaaaaattgcaaaaagaagaaatggtcaatgcgctctctagagcgttttagagctagaaatagcaagttaaaataaggctagtccgttatcaacttgaaaaagtggcaccgagtcggtgctgctttaactttttgctttggaaacatccaggttgtcctccgtttcttctttattcttcatttttctcgtttggaaaaatagttgaatgatgtggtagtataatgcattgctggaagttccgcctatcttaggggctgagccctcctaaagggttatccatgttacttggcgtaagtagcaaagctgcgtttgctgtctagaatatttatagggattgtataaagatacctttgttgtttggctctattatgtacagtcgtttagccgaagtgatgggtattacgtctggttatattttcaatatatgatggtatatgactatatccaactggctaaccttctcttgggaacctaactgtcgttcccctcgacagatgagcagaagaaccagctcatctgtccaaaaagcccctaataaacttatgcacactagttgtcctaccaaccacatgtctacgataactacccctacacatgtaaggctgttcatgcactggggctagaagatacatacggatagccacacgtgcattgatgtcacaccctcgtgatggcagcaatgctaaagcaaacgtagcatgcagctgccaggggtcggacgtctgactttccaggcccgataatctgccaatttacgttccacatacctgcttaatattttagtcaaagggaactccggaaggaaagccacaggagtcaatacttacttagcatataactttgttgggagcacgcaaatgatgtttcctccaccggcatctagcgcttctatatgtagccagcctttttcgtagcatatcttcacgccgtcgtcgtctaggtcccgagggacgctcccctctggcagcacttttcgcaggattcgtgccacaggttgggatatccttttcgctaacaaacgagcgccacattgttgtccgtttcaaggggggaaaaagatcgaacgccttctcattctggtgcagagttctccggatgtcgacatcttcgatcttaagcttgttttacgaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 243 - DNA, 11360 bp, Artificial Sequence
  Synthetic construct
gtgccgaattcggatccggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctgcaagaattcaagcttggagtcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcaggacgctactagaattcgagctcggaggaccctcactaggttcaatggtggcaacaagtcaccatttctgtattagaggactattacagtcttacttccttcccctcttcacagtctccacactgtcccaatattaacgtattgtgtacctttatgatctcatccactctgtagatctcaacagtctgcccagctgctgccatcccatagatgccgtggtcctttttcccgattctgaagcgatgcatgtgcccgtaggctttgattagattagcttcctaaaatattgcaacgagacaagacacaccctcttattaaagggtgtgtctagtgttaatctcactagcgtcacatgacctttccccatgtacatagttcactcctactcttcttccttccctacacgcttaaaggtctgccactctgtacaataccactttgtacagcctctttatgacctcgttcacgtcgtagatcttatcctctagcgttgtatagatcgatcctaaaccacggcaccatcctagaaacctagaatacacaaaagctaaggtgcgtctatttgaattagtagagtaatatgtttccaaccaatcaatggtcaatgcgctctctagagcgttttagagctagaaatagcaagttaaaataaggctagtccgttatcaacttgaaaaagtggcaccgagtcggtgctgctttcgatcttttttttcgccttattatcgattctccggcttcatattatctccgattctactcacaccaacctaggtagccttacagcttcctatgtcaaacgggaattagctatgttttataaagtctgttgtaaaagacggtcaagtctgttgtaaaagacggtcaagtctttagactcaccatcattttgatcgccctacaaatagatagaacttgggaagattacgaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 244 - DNA, 9772 bp, Artificial Sequence
  Synthetic construct
gtgccgatgtatcacctctcgcaagaattcaagcttggagtctcctcgtcgatcacggactcgacgtagcgtgagacgcggtcaaccatggacaagacctcctcaatggcgcgctcaagagactcaatgtcggaagtgacggaagtggaacggtcctcagcatccttggcgttggcgatagactcaagaccactcttgtcggcctcgccgtatcggagctcgtagggaacgggaatgaaagcagcgctgtcggcagcacgctcagcggtgacaccaacgggggcggaaatataggcgcgagtctcgagatcctttccagcctcagtagagacagtcaggtggacagcagggtgaggccaggtaccgtcaccctggccgctgtagaagttctggatcaaagcggagaaagtgttgagctcagaggcagtggcgtaccagccaaccaagacttcgcgggggttggccttcaggtgcaaagcaagcatctgcttgtggtattccatatcgacctcgacctggtcctcagcctcggagtggccgacggcgaaggcggatcggacctcgacctcgcttccatcctcagatcgtgttccgaggagtgtaccgatgactcgctcctggtcggcattgcggcgaagagagtggtcgagaactgagaagatggcctgaggaatgagctttacccctcagatcatacacacatatcgcaacatacctggggttgaatgaccacgttcagaggggcagtggtaggagcggtccccacgctaacggggccgagggggcgagcgagatgaaggaaagaatcttcggccatgattaatttggagatggatggaatatcttgcaagtttcaagatccaaacttccttcgtttctcggaggttcaatttttccttagaagtggagtgagccgctctgattgttccgattctgttgtgtgtgggaaatttcgcgctaagataagataagccccccaaaattctcatttcggccagaacagcttgggaacttgtccaacctgtttaattgtaccgaataatggtcaatgcgctctctagagcgttttagagctagaaatagcaagttaaaataaggctagtccgttatcaacttgaaaaagtggcaccgagtcggtgctgcttatagagcttgagtatgcgtttccggtagatattattttggtcatatggactatccctctataccacttcatctgttttgttgtttgtattgtgtcagtcagtttctgagctattttccctccaaaagggctatattaagtccaagttgtaccacctatctttaccagctttgattcgaagtgagggacattggaatatgagatgagagatgtggctagactccatatacatttatgcacagaactgtcgatatagtatgtccatgcacgggtttgcctatatatattatctaggatatcagatgggtaaacccatcaccattccaagtttgagacaattaagaagcccatatatattcatcatgtagatatatctttctccagatgttgatatgtaccatccaattgctgttctttgatagtatgtgattgcatcatctttttgaggaaagctggtgcagtagagaatatcatatctagagaatgcataatcaagctggcatcaatactctacattacctggtaaagctaaccgactggtcaccactaagatgcaaccctaactaggtaccgtacctagacgggtagtaggtagtcttatgtaatgcactttcacgtgcctacccatgttattactctaaaataggcaggcggtgtatttctgccagaaagtggggttaaattgaactttaaggctacacattttgcccttcggggcatatggtcaactgaaaatatacagagaagattagcatggcccctgcactaaggatgacacgctcaatcaaagagaagctaccaatttttttttcccttacagaccctgtattgaggatctagggtgtgggtctttttgcagtatctggttggtcctgccagatatcgagtcacgtgataatgtccaataacgtcgtgggttccgctttactagaattcgagctcggagggcctcatacttcttctatgacgctagccgagagcagcttgaagaactagtggccctgtacccagactccaccacgtacgggtctgcgttcaggacaggcgcggccaacaactggtatccgcaatttaagcgattggccgccattctcggcgacttggtcttgaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaaatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccataggcttctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggtacgctttacgaattcccatggggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtacccgcacagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 245 - DNA, 9249 bp, Artificial Sequence
  Synthetic construct
gtgccgatgtatcacctctcgcaagaattcaagcttggagtggtatggagtgtgacatagagtatgtccatatgatcttgcagaaaacccttcaatggtacacaagacattcgtcactatcttcacaacaactcgagtagtattttgtcaggttctattacaaacactctaaagtctctcccagtagactaccagatcctaaatggcgaagaacttgaggaaataagaaactatagtgtacagttataatcgagtaaaggacccgtgactggatctgagggacagagtaagttgactatcattcagaaatataacgtgccattgtggattggtgttaccaggaacctgggagacatacgaccatccccgcactctaattgtatcaatcgcgaccacatcactgatatcaaggatcagggcgccgtctcttttcacctataggaggctgtgttatgaaaatggcggaccagctcattccagtttttgttgggccaagatatcctatagatttccaaatcaagctttgtacataggcacaggcttctatagcattgagatacatacaccatatagtttacagatgtataattaaatgacaaaattctatagatataaactcagaaaggctagtatatcaaagaccaaagatcccagcgagggtcccgcgtggcacgcacctctagcacttcgacattcttcaggtcgttttgatcaacgatgaattcctggaggaaactcgctgaagatgagatgagcggctctagggcatagtgaccgtagttcaccatcccagggggatacttggaagtgatcgttgtcaacctaggtaaagtcccaaggttcattcaatccatggatgttgctatagatcttccctgaaagcttggcaggggatcgacaactttgattgggtaacattacggaatatgcccaggtgggtccatccgttgtcacaactaccaatagtattgtctgaacacaaggcggtgtgtttctgccccagagtggggttatatgtattgaactaaacgcatagacctaatggtcaatgcgctctctagagcgttttagagctagaaatagcaagttaaaataaggctagtccgttatcaacttgaaaaagtggcaccgagtcggtgctgcttgctcagttatagttctagggtacgagctttttgtgtatgttgtatatcattgcgatgttatactgtggatgtggatatcacgtgtccatcgccgttcgctctccatgttgtcacggtatattttggaaactttaaggatcagtccttcagggcataccgtgaagtgaaaatatgtagagaggattagcaaggccccctactattcttctccttcgacatcctttcctaaggtgtttatttcttgttattaataaacttgctttttatatttgttggtattctattatgtatccagctctcggcaattttatataaagtccaatgaaaagaaaatatcgtagaactcgtcaattgcattaatgatgccctcacaagaggaacgtaatagctgcagacatcgctactagaattcgagctcggagggcctcatacttcttctatgacgctagccgagagcagcttgaagaactagtggccctgtacccagactccaccacgtacgggtctgcgttcaggacaggcgcggccaacaactggtatccgcaatttaagcgattggccgccattctcggcgacttggtcttgaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaaatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccataggcttctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggtacgctttacgaattcccatggggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtacccgcacagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 246 - DNA, 9851 bp, Artificial Sequence
  Synthetic construct
gtgccgatgtatcacctctcgcaagaattcaagcttggagcacagtggctgttagggcaagacgtctagaggatgttctcctttgaacgtctttttagcgaaatgctgtatatttttgctcaaaggccccggggatacatattaaaactgcaataaatgctcatctgtggcatgtgccatgattctttgtggctttgtggtgagtggtggatgtgttagtagcctactaaacctgactatattgactgctactagtataattgttaacaaacaaaccgctttcttagaacataacctactgaccatgccagggcgtaataatagaagaatacataagatgtatggctattgtcaccgaatacaaagattgatttattgataacctttacctttgaggtttgcggataactgatgaagagtgtgaggatccatcagcatgatagcacagcattaacgacaggaccttctatggttttatcattgaactacctggttatggaaacggagagccagatggaaaaggagagggtcccggacatctaagcaggagctttatatactatgttcacatttacttattggaagtattgtacaggctacctaaaatagaaaggtattcccacgtggcaacatatctgtatttctttttttatggctgttctcattcagatcggctttcagatctgatcattgccgtgtgtgattgatatcttctcattggcaccatggcagagtatcgacgaccaagaaaagtcgattcgtttgtctgatagtatctagctctccagtgggacctaggccatctactaggagaaatagcctagttaatagtctgatagggcgtttagtctcgaacgatatagcgtccgaataaattcccccattgtcaacttcctgaacagaacgaaattttgatataccacaaccctaaaaatttcgaccaaccacccgccaaaacgccaaaaatcacgcaattgagctaaagaaaaaagaaaaggcctcgttttgaggcggaacgggcaaaaattgcaaaaagaagaaatggtcaatgcgctctctagagcgttttagagctagaaatagcaagttaaaataaggctagtccgttatcaacttgaaaaagtggcaccgagtcggtgctgctttaactttttgctttggaaacatccaggttgtcctccgtttcttctttattcttcatttttctcgtttggaaaaatagttgaatgatgtggtagtataatgcattgctggaagttccgcctatcttaggggctgagccctcctaaagggttatccatgttacttggcgtaagtagcaaagctgcgtttgctgtctagaatatttatagggattgtataaagatacctttgttgtttggctctattatgtacagtcgtttagccgaagtgatgggtattacgtctggttatattttcaatatatgatggtatatgactatatccaactggctaaccttctcttgggaacctaactgtcgttcccctcgacagatgagcagaagaaccagctcatctgtccaaaaagcccctaataaacttatgcacactagttgtcctaccaaccacatgtctacgataactacccctacacatgtaaggctgttcatgcactggggctagaagatacatacggatagccacacgtgcattgatgtcacaccctcgtgatggcagcaatgctaaagcaaacgtagcatgcagctgccaggggtcggacgtctgactttccaggcccgataatctgccaatttacgttccacatacctgcttaatattttagtcaaagggaactccggaaggaaagccacaggagtcaatacttacttagcatataactttgttgggagcacgcaaatgatgtttcctccaccggcatctagcgcttctatatgtagccagcctttttcgtagcatatcttcacgccgtcgtcgtctaggtcccgagggacgctcccctctggcagcacttttcgcaggattcgtgccacaggttgggatatccttttcgctaacaaacgagcgccacattgttgtccgtttcaaggggggaaaaagatcgaacgccttctcattctggtgcagagttctccggatgtcgacatcttcgatcttaagcttgttcgctactagaattcgagctcggagggcctcatacttcttctatgacgctagccgagagcagcttgaagaactagtggccctgtacccagactccaccacgtacgggtctgcgttcaggacaggcgcggccaacaactggtatccgcaatttaagcgattggccgccattctcggcgacttggtcttgaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaaatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccataggcttctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggtacgctttacgaattcccatggggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtacccgcacagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 247 - DNA, 8639 bp, Artificial Sequence
  Synthetic construct
gtgccgatgtatcacctctcgcaagaattcaagcttggaggaccctcactaggttcaatggtggcaacaagtcaccatttctgtattagaggactattacagtcttacttccttcccctcttcacagtctccacactgtcccaatattaacgtattgtgtacctttatgatctcatccactctgtagatctcaacagtctgcccagctgctgccatcccatagatgccgtggtcctttttcccgattctgaagcgatgcatgtgcccgtaggctttgattagattagcttcctaaaatattgcaacgagacaagacacaccctcttattaaagggtgtgtctagtgttaatctcactagcgtcacatgacctttccccatgtacatagttcactcctactcttcttccttccctacacgcttaaaggtctgccactctgtacaataccactttgtacagcctctttatgacctcgttcacgtcgtagatcttatcctctagcgttgtatagatcgatcctaaaccacggcaccatcctagaaacctagaatacacaaaagctaaggtgcgtctatttgaattagtagagtaatatgtttccaaccaatcaatggtcaatgcgctctctagagcgttttagagctagaaatagcaagttaaaataaggctagtccgttatcaacttgaaaaagtggcaccgagtcggtgctgctttcgatcttttttttcgccttattatcgattctccggcttcatattatctccgattctactcacaccaacctaggtagccttacagcttcctatgtcaaacgggaattagctatgttttataaagtctgttgtaaaagacggtcaagtctgttgtaaaagacggtcaagtctttagactcaccatcattttgatcgccctacaaatagatagaacttgggaagaactagaattcgagctcggagggcctcatacttcttctatgacgctagccgagagcagcttgaagaactagtggccctgtacccagactccaccacgtacgggtctgcgttcaggacaggcgcggccaacaactggtatccgcaatttaagcgattggccgccattctcggcgacttggtcttgaccattacccggcgggcattcctctcgtatgcagaggaaatctcccctgatcttccgaactggtcgtacctggcgacctatgactatggcaccccagttctggggaccttccacggaagtgacctgctgcaggtgttctatgggatcaagccaaactatgcagctagttctagccacacgtactatctgagctttgtgtatacgctcgatccgaactccaaccggggggagtacattgagtggccgcagtggaaggaatcgcggcagttgatgaatttcggagcgaacgacgccagtctccttacggatgatttccgcaacgggacatatgagttcatcctgcagaataccgcggcgttccacatctgatgccattggcggaggggtccggacggtcaggaacttagccttatgagatgaatgatggacgtgtctggcctcggaaaaggatatatggggatcatgatagtactagccatattaatgaagggcatataccacgcgttggacctgcgttatagcttcccgttagttatagtaccatcgttataccagccgatcaagtcaccacgcacgaccggggacggcgaatccccggcaattgaaagaaattgcatcccaggccagtgaggccagcgattggccacctctccaaggcacagggccattctgcagcgctggtggattcatcgcaatttcccccggcccggcccgacaccgctataggctggttctcccacaccatcggagattcgtcgcctaatgtctcgtccgttcacaagctgaagagcttgaagtggcgagatgtctctgcaggaattgaagctagatgctaagcgatattgcatggcaatatgtgttgatgcatgtgcttcttccttcagcttcccctcgtgcagatgaggtttggctataaattgaagtggttggtcggggttccgtgaggggctgaagtgcttcctcccttttagacgcaactgagagcctgagcttcatccccagcatcattacaccgtcaaaaatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccataggcttctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggtacgctttacgaattcccatggggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtacccgcacagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgcctttgcgacgctcaccgggctggttgccctcgccgctgggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggccaattcccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggcagatcctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtcttgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagcccctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct

SEQ ID NO: 248 - DNA, 26 bp, Artificial Sequence
  Synthetic construct
catacattcccaaaggtttcagctgg

SEQ ID NO: 249 - DNA, 32 bp, Artificial Sequence
  Synthetic construct
cagtgttggatttactctagccattcatttta

SEQ ID NO: 250 - DNA, 120 bp, Artificial Sequence
  Synthetic construct
attaattaatacgactcactatagtcaatgcgctctctagagcgttttagagctagaaatagcaagttaaaataaggctagtccgttatcaacttgaaaaagtggcaccgagtcggtgct

SEQ ID NO: 251 - DNA, 15228 bp, Artificial Sequence
  Synthetic construct
gtgccgaattcggatccggagggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgcgctgcaagaattcaagcttggagtcctggaagtgcgttgatcattattccccgaaaatgtagtacccagtaagtggtctagcggtggctatggtaggacatctatgcctaagctggagttctcattgaacgtgtaccggccgattgccctaaactctgattgagagccggaaacctcatctacctgatgctcaggggccatccaatagcttccgatagcattacagacagatggactcgtcttggcccacgggtctagaacagtcgccggaactgcctctatttgaaacggagctgaaccatgatacttaagcgtgccaagcggcgccgtttcccactggaacaaggagcaatagaattctgcagagattcttcattcaggctattcagcaattcggtttgtggagcggatcggggtccactgggtttagtctggggtttttctttgcccgcatgggctctagcacatgcacagcttgcagttgctgctacgctatctgggaaaacgaatggctattcaggagtttataaccaaaagagccggaaacaggctgattgccctctcacggggagacgttgtacttctgatccagaggctattaaccggacactacctataaaggaggtagcattcctttctgtccggctcccagattccaacaacccaactgacaggatcagcacaatgcaaatggacaagaagtactccattgggctcgatatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagactatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagattatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtctccacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatcatatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtttcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaaggatctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagcagggctgaccccaagaagaagaggaaggtgtgagcttgagttctgtagcgaagtcaggacctttgtccgcgcttccttgatcctgcacggggctgccgtcatctctggtttctgatatggtattcagctatactgtcactcgaagtcctataactctcttactagcaatatgcttagccaagaactatatcaggagagttttactaaacaggatctctcaataacatggagtagcctggcaattataaatctagtattaaatctagtactaactcgatagatatagggcttttctggcgaatgcctgtatggtagctggaactcgcactgctgcaggacgctactagaattcgagctcggagtggatcccccgggctgcaggaattcgagctctgtacagtgaccggtgactctttctggcatgcggagagacggacggacgcagagagaagggctgagtaataagccactggccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgactaacagctaccccgcttgagcagacatcaccatgcctcaatcctgggaagaactggccgctgataagcgcgcccgcctcgcaaaaaccatccctgatgaatggaaagtccagacgctgcctgcggatgacagcgttattgatttcccaaagaaatcggggatcctttcagaggccgaactgaagatcacagaggcctccgctgcagatcttgtgtccaagctggcggccggagagttgacctcggtggaagttacgctagcattctgtaaacgggcagcaatcgcccagcagttagtagggtcccctctacctctcagggagatgtaacaacgccaccttatgggactatcaagctgacgctggcttctgtgcagacaaactgcgcccacgagttcttccctgacgccgctctcgcgcaggcaagggaactcgatgaatactacgcaaagcacaagacacccgttggtccactccatggcctccccatctctctcaaagaccagcttcgagtcaaggtacaccgttgcccctaagtcgttagatgtccctttttgtcagctaacatatgccaccagggctacgaaacatcaatgggctacatctcatggctaaacaagtacgacgaaggggactcggttctgacaaccatgctccgcaaagccggtgccgttttctacgtcaagacctctgtcccgcagaccctgatggtctgcgagacagtcaacaacatcatcgggcgcaccgtcaacccacgcaacaagaactggtcgtgcggcggcagttctggtggtgagggtgcgatcgttgggattcgtggtggcgtcatcggtgtaggaacggatatcggtggctcgattcgagtgccggccgcgttcaacttcctgtacggtctaaggccgagtcatgggcggctgccgtatgcaaagatggcgaacagcatggagggtcaggagacggtgcacagcgttgtcgggccgattacgcactctgttgagggtgagtccttcgcctcttccttcttttcctgctctataccaggcctccactgtcctcctttcttgctttttatactatatacgagacgggcagtcactgatgaagtaatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccataggcttctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatattggctgggttgatggctgcttcgagtgcagtctcatgctgccacaggtgactctggatggccccataccactcaacccatggtacgagcggtacgctttacgaattcccatggggagaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtacccgcacagagaggatgcacatgtgaccgagggacacgaagtgatccgtttaaactatcagtgtttgacaggatatattggcgggtaaacctaagagaaaagagcgtttattagaataatcggatatttaaaagggcgtgaaaaggtttatccgttcgtccatttgtatgtgccagccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaagcttctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaacagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggctccgagtgcgcggaacccctatttgtttatttttctaaatacattcaaatatgtatccgctcatgagacaataaccctgataaatgcttcaataatattgaaaaaggaagagtatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaggacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgctcagggaggatatcggggaagaacagtatgtcgagctattttttgacttactggggatcaagcctgattgggagaaaataaaatattatattttactggatgaattgttttagctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgctcggatctgttggaccggacagtagtcatggttgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggttgaacactct
